US006696561B1

United States Patent
Pompejus et al.

(10) Patent No.: US 6,696,561 B1
(45) Date of Patent: Feb. 24, 2004

(54) CORYNEBACTERIUM GLUTAMICUM GENES ENCODING PROTEINS INVOLVED IN MEMBRANE SYNTHESIS AND MEMBRANE TRANSPORT

(75) Inventors: Markus Pompejus, Freinsheim (DE); Burkhard Kröger, Limburgerhof (DE); Hartwig Schröder, Nussloch (DE); Oskar Zelder, Speyer (DE); Gregor Haberhauer, Limburgerhof (DE)

(73) Assignee: BASF Aktiengesellschaft, Ludwigshafen (DE)

( * ) Notice: Subject to any disclaimer, the term of this patent is extended or adjusted under 35 U.S.C. 154(b) by 0 days.

(21) Appl. No.: 09/602,787

(22) Filed: Jun. 23, 2000

Related U.S. Application Data
(60) Provisional application No. 60/141,031, filed on Jun. 25, 1999.

(30) Foreign Application Priority Data

| Jul. 9, 1909 | (DE) | 19932128 |
| Jul. 8, 1999 | (DE) | 19931454 |
| Jul. 8, 1999 | (DE) | 19931478 |
| Jul. 8, 1999 | (DE) | 19931563 |
| Jul. 9, 1999 | (DE) | 19932122 |
| Jul. 9, 1999 | (DE) | 19932124 |
| Jul. 9, 1999 | (DE) | 19932125 |
| Jul. 9, 1999 | (DE) | 19932180 |
| Jul. 9, 1999 | (DE) | 19932182 |
| Jul. 9, 1999 | (DE) | 19932190 |
| Jul. 9, 1999 | (DE) | 19932191 |
| Jul. 9, 1999 | (DE) | 19932209 |
| Jul. 9, 1999 | (DE) | 19932212 |
| Jul. 9, 1999 | (DE) | 19932227 |
| Jul. 9, 1999 | (DE) | 19932228 |
| Jul. 9, 1999 | (DE) | 19932229 |
| Jul. 9, 1999 | (DE) | 19932230 |
| Jul. 14, 1999 | (DE) | 19932927 |
| Jul. 14, 1999 | (DE) | 19933005 |
| Jul. 14, 1999 | (DE) | 19933006 |
| Aug. 27, 1999 | (DE) | 19940764 |
| Aug. 27, 1999 | (DE) | 19940765 |
| Aug. 27, 1999 | (DE) | 19940766 |
| Aug. 27, 1999 | (DE) | 19940830 |
| Aug. 27, 1999 | (DE) | 19940831 |
| Aug. 27, 1999 | (DE) | 19940832 |
| Aug. 27, 1999 | (DE) | 19940833 |
| Sep. 3, 1999 | (DE) | 19942088 |

(51) Int. Cl.$^7$ .............. C12N 15/31; C07K 14/195
(52) U.S. Cl. .......................... 536/23.7; 530/350
(58) Field of Search ............. 435/69.1, 252.3; 536/23.7; 530/350

(56) References Cited

FOREIGN PATENT DOCUMENTS

| EP | 252 558 A2 A3 | 1/1988 |
| EP | 752 472 A1 | 1/1997 |
| EP | 0 786 519 A2 * | 7/1997 |

OTHER PUBLICATIONS

Accession A89996, Kuroda et al, May 2001, Probabale Ammonium Transporter nrgA, Protein Information Resource Database.*

Eggeling, L. et al. (1996) "Transport Mutants and Transport Genes of *Corynebacterium glutamicum*" *Annals of the New York Academy of Sciences* 782:191–201.

Siewe, R.M. et al. (Mar. 8, 1996) "Functional and Genetic Characterization of the (Methyl)ammonium Uptake Carrier of *Corynebacterium glutamicum*" *J. Biol. Chem.* 271(10): 5398–5403.

* cited by examiner

*Primary Examiner*—John S. Brusca
(74) *Attorney, Agent, or Firm*—Lahive & Cockfield, LLP; Giulio A. DeConti, Jr., Esq.; Elizabeth A. Hanley, Esq.

(57) ABSTRACT

Isolated nucleic acid molecules, designated MCT nucleic acid molecules, which encode novel MCT proteins from *Corynebacterium glutamicum* are described. The invention also provides antisense nucleic acid molecules, recombinant expression vectors containing MCT nucleic acid molecules, and host cells into which the expression vectors have been introduced. The invention still further provides isolated MCT proteins, mutated MCT proteins, fusion proteins, antigenic peptides and methods for the improvement of production of a desired compound from *C. glutamicum* based on genetic engineering of MCT genes in this organism.

2 Claims, No Drawings

CORYNEBACTERIUM GLUTAMICUM GENES ENCODING PROTEINS INVOLVED IN MEMBRANE SYNTHESIS AND MEMBRANE TRANSPORT

RELATED APPLICATIONS

This application claims priority to prior filed U.S. Provisional Patent Application Ser. No. 60/141031, filed Jun. 25, 1999. This application also claims priority to German Patent Application No. 19931454.3, filed Jul. 8, 1999, German Patent Application No. 19931478.0, filed Jul. 8, 1999, German Patent Application No. 19931563.9, filed Jul. 8, 1999, German Patent Application No. 19932122.1, filed Jul. 9, 1999, German Patent Application No. 19932124.8, filed Jul. 9, 1999, German Patent Application No. 19932125.6, filed Jul. 9, 1999, German Patent Application No. 19932128.0, filed Jul. 9, 1999, German Patent Application No. 19932180.9, filed Jul. 9, 1999, German Patent Application No. 19932182.5, filed Jul. 9, 1999, German Patent Application No. 19932190.6, filed Jul. 9, 1999, German Patent Application No. 19932191.4, filed Jul. 9, 1999, German Patent Application No. 19932209.0, filed Jul. 9, 1999, German Patent Application No. 19932212.0, filed Jul. 9, 1999, German Patent Application No. 19932227.9, filed Jul. 9, 1999, German Patent Application No. 19932228.7, filed Jul. 9, 1999, German Patent Application No. 19932229.5, filed 99070, German Patent Application No. 19932230.9, filed Jul. 9, 1999, German Patent Application No. 19932927.3, filed Jul. 14, 1999, German Patent Application No. 19933005.0, filed Jul. 14, 1999, German Patent Application No. 19933006.9, filed Jul. 14, 1999, German Patent Application No. 19940764.9, filed Aug. 27, 1999, German Patent Application No. 19940765.7, filed Aug. 27, 1999, German Patent Application No. 19940766.5, filed Aug. 27, 1999, German Patent Application No. 19940830.0, filed Aug. 27, 1999, German Patent Application No. 19940831.9, filed Aug. 27, 1999, German Patent Application No. 19940832.7, filed Aug. 27, 1999, German Patent Application No. 19940833.5, filed Aug. 27, 1999, German Patent Application No. 19941378.9 filed Aug. 31, 1999, German Patent Application No. 19941379.7, filed Aug. 31, 1999, German Patent Application No. 19941395.9, filed Aug. 31, 1999, German Patent Application No. 19942077.7, filed Sep. 3, 1999, German Patent Application No. 19942078.5, filed Sep. 3, 1999, German Patent Application No. 19942079.3, filed Sep. 3, 1999, and German Patent Application No. 19942088.2, filed Sep. 3, 1999. The entire contents of all of the above referenced applications are hereby expressly incorporated herein by this reference.

BACKGROUND OF THE INVENTION

Certain products and by-products of naturally-occurring metabolic processes in cells have utility in a wide array of industries, including the food, feed, cosmetics, and pharmaceutical industries. These molecules, collectively termed 'fine chemicals', include organic acids, both proteinogenic and non-proteinogenic amino acids, nucleotides and nucleosides, lipids and fatty acids, diols, carbohydrates, aromatic compounds, vitamins and cofactors, and enzymes. Their production is most conveniently performed through the large-scale culture of bacteria developed to produce and secrete large quantities of one or more desired molecules. One particularly useful organism for this purpose is Corynebacterium glutamicum, a gram positive, nonpathogenic bacterium. Through strain selection, a number of mutant strains have been developed which produce an array of desirable compounds. However, selection of strains improved for the production of a particular molecule is a time-consuming and difficult process.

SUMMARY OF THE INVENTION

The invention provides novel bacterial nucleic acid molecules which have a variety of uses. These uses include the identification of microorganisms which can be used to produce fine chemicals, the modulation of fine chemical production in C. glutamicum or related bacteria, the typing or identification of C. glutamicum or related bacteria, as reference points for mapping the C. glutamicum genome, and as markers for transformation. These novel nucleic acid molecules encode proteins, referred to herein as membrane construction and membrane transport (MCT) proteins.

C. glutamicum is a gram positive, aerobic bacterium which is commonly used in industry for the large-scale production of a variety of fine chemicals, and also for the degradation of hydrocarbons (such as in petroleum spills) and for the oxidation of terpenoids. The MCT nucleic acid molecules of the invention, therefore, can be used to identify microorganisms which can be used to produce fine chemicals, e.g., by fermentation processes. Modulation of the expression of the MCT nucleic acids of the invention, or modification of the sequence of the MCT nucleic acid molecules of the invention, can be used to modulate the production of one or more fine chemicals from a microorganism (e.g., to improve the yield or production of one or more fine chemicals from a Corynebacterium or Brevibacterium species).

The MCT nucleic acids of the invention may also be used to identify an organism as being Corynebacterium glutamicum or a close relative thereof, or to identify the presence of C. glutamicum or a relative thereof in a mixed population of microorganisms. The invention provides the nucleic acid sequences of a number of C. glutamicum genes; by probing the extracted genomic DNA of a culture of a unique or mixed population of microorganisms under stringent conditions with a probe spanning a region of a C. glutamicum gene which is unique to this organism, one can ascertain whether this organism is present. Although Corynebacterium glulamicum itself is nonpathogenic, it is related to species pathogenic in humans, such as Corynebacterium diphtheriae (the causative agent of diphtheria); the detection of such organisms is of significant clinical relevance.

The MCT nucleic acid molecules of the invention may also serve as reference points for mapping of the C. glutamicum genome, or of genomes of related organisms. Similarly, these molecules, or variants or portions thereof, may serve as markers for genetically engineered Corynebacterium or Brevibacterium species. e.g. e.g. The MCT proteins encoded by the novel nucleic acid molecules of the invention are capable of, for example, performing a function involved in the metabolism (e.g., the biosynthesis or degradation) of compounds necessary for membrane biosynthesis, or of assisting in the transmembrane transport of one or more compounds either into or out of the cell. Given the availability of cloning vectors for use in Corynebacterium glutamicum, such as those disclosed in Sinskey et al., U.S. Pat. No. 4,649,119, and techniques for genetic manipulation of C. glutamicum and the related Brevibacterium species (e.g., lactofermentum) (Yoshihama et al, J. Bacteriol. 162: 591–597 (1985); Katsumata et al., J. Bacteriol. 159: 306–311 (1984); and Santamaria et al., J. Gen. Microbiol. 130: 2237–2246 (1984)), the nucleic acid molecules of the invention may be utilized in the genetic engineering of this organism to make it a better or more efficient producer of one or more fine chemicals. This improved production or efficiency of production of a fine chemical may be due to a direct effect of manipulation of a gene of the invention, or it may be due to an indirect effect of such manipulation.

There are a number of mechanisms by which the alteration of an MCT protein of the invention may directly affect the yield, production, and/or efficiency of production of a fine chemical from a *C. glutamicum* strain incorporating such an altered protein. Those MCT proteins involved in the export of fine chemical molecules from the cell may be increased in number or activity such that greater quantities of these compounds are secreted to the extracellular medium, from which they are more readily recovered. Similarly, those MCT proteins involved in the import of nutrients necessary for the biosynthesis of one or more fine chemicals (e.g., phosphate, sulfate, nitrogen compounds, etc.) may be increased in number or activity such that these precursors, cofactors, or intermediate compounds are increased in concentration within the cell. Further, fatty acids and lipids themselves are desirable fine chemicals; by optimizing the activity or increasing the number of one or more MCT proteins of the invention which participate in the biosynthesis of these compounds, or by impairing the activity of one or more MCT proteins which are involved in the degradation of these compounds, it may be possible to increase the yield, production, and/or efficiency of production of fatty acid and lipid molecules from *C. glutamicum*.

The mutagenesis of one or more MCT genes of the invention may also result in MCT proteins having altered activities which indirectly impact the production of one or more desired fine chemicals from *C. glutamicum*. For example, MCT proteins of the invention involved in the export of waste products may be increased in number or activity such that the normal metabolic wastes of the cell (possibly increased in quantity due to the overproduction of the desired fine chemical) are efficiently exported before they are able to damage nucleotides and proteins within the cell (which would decrease the viability of the cell) or to interfere with fine chemical biosynthetic pathways (which would decrease the yield, production, or efficiency of production of the desired fine chemical). Further, the relatively large intracellular quantities of the desired fine chemical may in itself be toxic to the cell, so by increasing the activity or number of transporters able to export this compound from the cell, one may increase the viability of the cell in culture, in turn leading to a greater number of cells in the culture producing the desired fine chemical. The MCT proteins of the invention may also be manipulated such that the relative amounts of different lipid and fatty acid molecules are produced. This may have a profound effect on the lipid composition of the membrane of the cell. Since each type of lipid has different physical properties, an alteration in the lipid composition of a membrane may significantly alter membrane fluidity. Changes in membrane fluidity can impact the transport of molecules across the membrane, as well as the integrity of the cell, both of which have a profound effect on the production of fine chemicals from *C. glutamicum* in large-scale fermentative culture.

The invention provides novel nucleic acid molecules which encode proteins, referred to herein as MCT proteins, which are capable of, for example, participating in the metabolism of compounds necessary for the construction of cellular membranes in *C. glutamicum*, or in the transport of molecules across these membranes. Nucleic acid molecules encoding an MCT protein are referred to herein as MCT nucleic acid molecules. In a preferred embodiment, the MCT protein participates in the metabolism of compounds necessary for the construction of cellular membranes in *C. glutamicum*, or in the transport of molecules across these membranes. Examples of such proteins include those encoded by the genes set forth in Table 1.

Accordingly, one aspect of the invention pertains to isolated nucleic acid molecules (e.g., cDNAs, DNAs, or RNAs) comprising a nucleotide sequence encoding an MCT protein or biologically active portions thereof, as well as nucleic acid fragments suitable as primers or hybridization probes for the detection or amplification of MCT-encoding nucleic acid (e.g., DNA or mRNA). In particularly preferred embodiments, the isolated nucleic acid molecule comprises one of the nucleotide sequences set forth in Appendix A or the coding region or a complement thereof of one of these nucleotide sequences. In other particularly preferred embodiments, the isolated nucleic acid molecule of the invention comprises a nucleotide sequence which hybridizes to or is at least about 50%, preferably at least about 60%, more preferably at least about 70%, 80% or 90%, and even more preferably at least about 95%, 96%, 97%, 98%, 99% or more homologous to a nucleotide sequence set forth in Appendix A, or a portion thereof. In other preferred embodiments, the isolated nucleic acid molecule encodes one of the amino acid sequences set forth in Appendix B. The preferred MCT proteins of the present invention also preferably possess at least one of the MCT activities described herein.

In another embodiment, the isolated nucleic acid molecule encodes a protein or portion thereof wherein the protein or portion thereof includes an amino acid sequence which is sufficiently homologous to an amino acid sequence of Appendix B, e.g., sufficiently homologous to an amino acid sequence of Appendix B such that the protein or portion thereof maintains an MCT activity. Preferably, the protein or portion thereof encoded by the nucleic acid molecule maintains the ability to participate in the metabolism of compounds necessary for the construction of cellular membranes in *C. glutamicum*, or in the transport of molecules across these membranes. In one embodiment, the protein encoded by the nucleic acid molecule is at least about 50%, preferably at least about 60%, and more preferably at least about 70%, 80%, or 90% and most preferably at least about 95%, 96%, 97%, 98%, or 99% or more homologous to an amino acid sequence of Appendix B (e.g., an entire amino acid sequence selected from those sequences set forth in Appendix B). In another preferred embodiment, the protein is a full length *C. glutamicum* protein which is substantially homologous to an entire amino acid sequence of Appendix B (encoded by an open reading frame shown in Appendix A).

In another preferred embodiment, the isolated nucleic acid molecule is derived from *C. glutamicum* and encodes a protein (e.g., an MCT fusion protein) which includes a biologically active domain which is at least about 50% or more homologous to one of the amino acid sequences of Appendix B and is able to participate in the metabolism of compounds necessary for the construction of cellular membranes in *C. glutamicum*, or in the transport of molecules across these membranes, or has one or more of the activities set forth in Table 1, and which also includes heterologous nucleic acid sequences encoding a heterologous polypeptide or regulatory regions.

In another embodiment, the isolated nucleic acid molecule is at least 15 nucleotides in length and hybridizes under stringent conditions to a nucleic acid molecule comprising a nucleotide sequence of Appendix A. Preferably, the isolated nucleic acid molecule corresponds to a naturally-occurring nucleic acid molecule. More preferably, the isolated nucleic acid encodes a naturally-occurring *C. glutamicum* MCT protein, or a biologically active portion thereof.

Another aspect of the invention pertains to vectors, e.g., recombinant expression vectors, containing the nucleic acid molecules of the invention, and host cells into which such vectors have been introduced. In one embodiment, such a host cell is used to produce an MCT protein by culturing the host cell in a suitable medium. The MCT protein can be then isolated from the medium or the host cell.

Yet another aspect of the invention pertains to a genetically altered microorganism in which an MCT gene has been introduced or altered. In one embodiment, the genome of the microorganism has been altered by introduction of a nucleic acid molecule of the invention encoding wild-type or mutated MCT sequence as a transgene. In another embodiment, an endogenous MCT gene within the genome of the microorganism has been altered, e.g., functionally disrupted, by homologous recombination with an altered MCT gene. In another embodiment, an endogenous or introduced MCT gene in a microorganism has been altered by one or more point mutations, deletions, or inversions, but still encodes a functional MCT protein. In still another embodiment, one or more of the regulatory regions (e.g., a promoter, repressor, or inducer) of an MCT gene in a microorganism has been altered (e.g., by deletion, truncation, inversion, or point mutation) such that the expression of the MCT gene is modulated. In a preferred embodiment, the microorganism belongs to the genus Corynebacterium or Brevibacterium, with *Corynebacterium glutamicum* being particularly preferred. In a preferred embodiment, the microorganism is also utilized for the production of a desired compound, such as an amino acid, with lysine being particularly preferred.

In another aspect, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject.

Still another aspect of the invention pertains to an isolated MCT protein or a portion, e.g., a biologically active portion, thereof. In a preferred embodiment, the isolated MCT protein or portion thereof can participate in the metabolism of compounds necessary for the construction of cellular membranes in *C. glutamicum,* or in the transport of molecules across these membranes. In another preferred embodiment, the isolated MCT protein or portion thereof is sufficiently homologous to an amino acid sequence of Appendix B such that the protein or portion thereof maintains the ability to participate in the metabolism of compounds necessary for the construction of cellular membranes in *C. glutamicum,* or in the transport of molecules across these membranes.

The invention also provides an isolated preparation of an MCT protein. In preferred embodiments, the MCT protein comprises an amino acid sequence of Appendix B. In another preferred embodiment, the invention pertains to an isolated full length protein which is substantially homologous to an entire amino acid sequence of Appendix B (encoded by an open reading frame set forth in Appendix A). In yet another embodiment, the protein is at least about 50%, preferably at least about 60%, and more preferably at least about 70%, 80%, or 90%, and most preferably at least about 95%, 96%, 97%, 98%, or 99% or more homologous to an entire amino acid sequence of Appendix B. In other embodiments, the isolated MCT protein comprises an amino acid sequence which is at least about 50% or more homologous to one of the amino acid sequences of Appendix B and is able to participate in the metabolism of compounds necessary for the construction of cellular membranes in *C. glutamicum,* or in the transport of molecules across these membranes, or has one or more of the activities set forth in Table 1.

Alternatively, the isolated MCT protein can comprise an amino acid sequence which is encoded by a nucleotide sequence which hybridizes, e.g., hybridizes under stringent conditions, or is at least about 50%, preferably at least about 60%, more preferably at least about 70%, 80%, or 90%, and even more preferably at least about 95%, 96%, 97%, 98,%, or 99% or more homologous, to a nucleotide sequence of Appendix B. It is also preferred that the preferred forms of MCT proteins also have one or more of the MCT bioactivities described herein.

The MCT polypeptide, or a biologically active portion thereof, can be operatively linked to a non-MCT polypeptide to form a fusion protein. In preferred embodiments, this fusion protein has an activity which differs from that of the MCT protein alone. In other preferred embodiments, this fusion protein participate in the metabolism of compounds necessary for the construction of cellular membranes in *C. glutamicum,* or in the transport of molecules across these membranes. In particularly preferred embodiments, integration of this fusion protein into a host cell modulates production of a desired compound from the cell.

In another aspect, the invention provides methods for screening molecules which modulate the activity of an MCT protein, either by interacting with the protein itself or a substrate or binding partner of the MCT protein, or by modulating the transcription or translation of an MCT nucleic acid molecule of the invention.

Another aspect of the invention pertains to a method for producing a fine chemical. This method involves the culturing of a cell containing a vector directing the expression of an MCT nucleic acid molecule of the invention, such that a fine chemical is produced. In a preferred embodiment, this method further includes the step of obtaining a cell containing such a vector, in which a cell is transfected with a vector directing the expression of an MCT nucleic acid. In another preferred embodiment, this method further includes the step of recovering the fine chemical from the culture. In a particularly preferred embodiment, the cell is from the genus Corynebacterium or Brevibacterium, or is selected from those strains set forth in Table 3.

Another aspect of the invention pertains to methods for modulating production of a molecule from a microorganism. Such methods include contacting the cell with an agent which modulates MCT protein activity or MCT nucleic acid expression such that a cell associated activity is altered relative to this same activity in the absence of the agent. In a preferred embodiment, the cell is modulated for one or more *C. glutamicum* metabolic pathways for cell membrane components or is modulated for the transport of compounds across such membranes, such that the yields or rate of production of a desired fine chemical by this microorganism is improved. The agent which modulates MCT protein activity can be an agent which stimulates MCT protein activity or MCT nucleic acid expression. Examples of agents which stimulate MCT protein activity or MCT nucleic acid expression include small molecules, active MCT proteins, and nucleic acids encoding MCT proteins that have been introduced into the cell. Examples of agents which inhibit MCT activity or expression include small molecules and antisense MCT nucleic acid molecules.

Another aspect of the invention pertains to methods for modulating yields of a desired compound from a cell, involving the introduction of a wild-type or mutant MCT gene into a cell, either maintained on a separate plasmid or integrated into the genome of the host cell. If integrated into the genome, such integration can be random, or it can take place by homologous recombination such that the native gene is replaced by the introduced copy, causing the production of the desired compound from the cell to be modulated. In a preferred embodiment, said yields are increased. In another preferred embodiment, said chemical is a fine chemical. In a particularly preferred embodiment, said fine chemical is an amino acid. In especially preferred embodiments, said amino acid is L-lysine.

DETAILED DESCRIPTION OF THE INVENTION

The present invention provides MCT nucleic acid and protein molecules which are involved in the metabolism of cellular membrane components in *C. glutamicum* or in the transport of compounds across such membranes. The molecules of the invention may be utilized in the modulation of production of fine chemicals from microorganisms, such as *C. glutamicum*, either directly (e.g., where overexpression or optimization of a fatty acid biosynthesis protein has a direct impact on the yield, production, and/or efficiency of production of the fatty acid from modified *C. glutamicum*), or may have an indirect impact which nonetheless results in an increase of yield, production, and/or efficiency of production of the desired compound (e.g., where modulation of the metabolism of cell membrane components results in alterations in the yield, production, and/or efficiency of production or the composition of the cell membrane, which in turn may impact the production of one or more fine chemicals). Aspects of the invention are further explicated below.

I. Fine Chemicals

The term 'fine chemical' is art-recognized and includes molecules produced by an organism which have applications in various industries, such as, but not limited to, the pharmaceutical, agriculture, and cosmetics industries. Such compounds include organic acids, such as tartaric acid, itaconic acid, and diaminopimelic acid, both proteinogenic and non-proteinogenic amino acids, purine and pyrimidine bases, nucleosides, and nucleotides (as described e.g. in Kuninaka, A. (1996) Nucleotides and related compounds, p. 561–612, in Biotechnology vol. 6, Rehm et al., eds. VCH: Weinheim, and references contained therein), lipids, both saturated and unsaturated fatty acids (e.g., arachidonic acid), diols (e.g., propane diol, and butane diol), carbohydrates (e.g., hyaluronic acid and trehalose), aromatic compounds (e.g., aromatic amines, vanillin, and indigo), vitamins and cofactors (as described in Ullmann's Encyclopedia of Industrial Chemistry, vol. A27, "Vitamins", p. 443–613 (1996) VCH: Weinheim and references therein; and Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1–3, 1994 at Penang, Malaysia, AOCS Press, (1995)), enzymes, polyketides (Cane et al. (1998) *Science* 282: 63–68), and all other chemicals described in Gutcho (1983) Chemicals by Fermentation, Noyes Data Corporation, ISBN: 0818805086 and references therein. The metabolism and uses of certain of these fine chemicals are further explicated below.

A. Amino Acid Metabolism and Uses

Amino acids comprise the basic structural units of all proteins, and as such are essential for normal cellular functioning in all organisms. The term "amino acid" is art-recognized. The proteinogenic amino acids, of which there are 20 species, serve as structural units for proteins, in which they are linked by peptide bonds, while the nonproteinogenic amino acids (hundreds of which are known) are not normally found in proteins (see Ulmann's Encyclopedia of Industrial Chemistry, vol. A2, p. 57–97 VCH: Weinheim (1985)). Amino acids may be in the D- or L-optical configuration, though L-amino acids are generally the only type found in naturally-occurring proteins. Biosynthetic and degradative pathways of each of the 20 proteinogenic amino acids have been well characterized in both prokaryotic and eukaryotic cells (see, for example, Stryer, L. Biochemistry, $3^{rd}$ edition, pages 578–590 (1988)). The 'essential' amino acids (histidine, isoleucine, leucine, lysine, methionine, phenylalanine, threonine, tryptophan, and valine), so named because they are generally a nutritional requirement due to the complexity of their biosyntheses, are readily converted by simple biosynthetic pathways to the remaining 11 'nonessential' amino acids (alanine, arginine, asparagine, aspartate, cysteine, glutamate, glutamine, glycine, proline, serine, and tyrosine). Higher animals do retain the ability to synthesize some of these amino acids, but the essential amino acids must be supplied from the diet in order for normal protein synthesis to occur.

Aside from their function in protein biosynthesis, these amino acids are interesting chemicals in their own right, and many have been found to have various applications in the food, feed, chemical, cosmetics, agriculture, and pharmaceutical industries. Lysine is an important amino acid in the nutrition not only of humans, but also of monogastric animals such as poultry and swine. Glutamate is most commonly used as a flavor additive (mono-sodium glutamate, MSG) and is widely used throughout the food industry, as are aspartate, phenylalanine, glycine, and cysteine. Glycine, L-methionine and tryptophan are all utilized in the pharmaceutical industry. Glutamine, valine, leucine, isoleucine, histidine, arginine, proline, serine and alanine are of use in both the pharmaceutical and cosmetics industries. Threonine, tryptophan, and D/L-methionine are common feed additives. (Leuchtenberger, W. (1996) Amino aids—technical production and use, p. 466–502 in Rehm et al. (eds.) Biotechnology vol. 6, chapter 14a, VCH: Weinheim). Additionally, these amino acids have been found to be useful as precursors for the synthesis of synthetic amino acids and proteins, such as N-acetylcysteine, S-carboxymethyl-L-cysteine, (S)-5-hydroxytryptophan, and others described in Ulmann's Encyclopedia of Industrial Chemistry, vol. A2, p. 57–97, VCH: Weinheim, 1985.

The biosynthesis of these natural amino acids in organisms capable of producing them, such as bacteria, has been well characterized (for review of bacterial amino acid biosynthesis and regulation thereof, see Umbarger, H. E.(1978) *Ann. Rev. Biochem.* 47: 533–606). Glutamate is synthesized by the reductive amination of α-ketoglutarate, an intermediate in the citric acid cycle. Glutamine, proline, and arginine are each subsequently produced from glutamate. The biosynthesis of serine is a three-step process beginning with 3-phosphoglycerate (an intermediate in glycolysis), and resulting in this amino acid after oxidation, transamination, and hydrolysis steps. Both cysteine and glycine are produced from serine; the former by the condensation of homocysteine with serine, and the latter by the transferal of the side-chain β-carbon atom to tetrahydrofolate, in a reaction catalyzed by serine transhydroxymethylase. Phenylalanine, and tyrosine are synthesized from the glycolytic and pentose phosphate pathway precursors erythrose 4-phosphate and phosphoenolpyruvate in a 9-step biosynthetic pathway that differ only at the final two steps after synthesis of prephenate. Tryptophan is also produced from these two initial molecules, but its synthesis is an 11-step pathway. Tyrosine may also be synthesized from phenylalanine, in a reaction catalyzed by phenylalanine hydroxylase. Alanine, valine, and leucine are all biosynthetic products of pyruvate, the final product of glycolysis. Aspartate is formed from oxaloacetate, an intermediate of the citric acid cycle. Asparagine, methionine, threonine, and lysine are each produced by the conversion of aspartate. Isoleucine is formed from threonine. A complex 9-step pathway results in the production of histidine from 5-phosphoribosyl-1-pyrophosphate, an activated sugar.

Amino acids in excess of the protein synthesis needs of the cell cannot be stored, and are instead degraded to provide intermediates for the major metabolic pathways of the cell (for review see Stryer, L. Biochemistry $3^{rd}$ ed. Ch. 21 "Amino Acid Degradation and the Urea Cycle" p. 495–516 (1988)). Although the cell is able to convert unwanted amino acids into useful metabolic intermediates, amino acid production is costly in terms of energy, precursor molecules, and the enzymes necessary to synthesize them. Thus it is not surprising that amino acid biosynthesis is regulated by feedback inhibition, in which the presence of a particular amino acid serves to slow or entirely stop its own production (for overview of feedback mechanisms in amino acid biosynthetic pathways, see Stryer, L. Biochemistry, $3^{rd}$ ed. Ch. 24: "Biosynthesis of Amino Acids and Heme" p. 575–600 (1988)). Thus, the output of any particular amino acid is limited by the amount of that amino acid present in the cell.

B. Vitamin, Cofactor, and Nutraceutical Metabolism and Uses

Vitamins, cofactors, and nutraceuticals comprise another group of molecules which the higher animals have lost the ability to synthesize and so must ingest, although they are readily synthesized by other organisms such as bacteria. These molecules are either bioactive substances themselves, or are precursors of biologically active substances which may serve as electron carriers or intermediates in a variety of metabolic pathways. Aside from their nutritive value, these compounds also have significant industrial value as coloring agents, antioxidants, and catalysts or other processing aids. (For an overview of the structure, activity, and industrial applications of these compounds, see, for example, Ullman's Encyclopedia of Industrial Chemistry, "Vitamins" vol. A27, p. 443–613, VCH: Weinheim, 1996.) The term "vitamin" is art-recognized, and includes nutrients which are required by an organism for normal functioning, but which that organism cannot synthesize by itself. The group of vitamins may encompass cofactors and nutraceutical compounds. The language "cofactor" includes nonproteinaceous compounds required for a normal enzymatic activity to occur. Such compounds may be organic or inorganic; the cofactor molecules of the invention are preferably organic. The term "nutraceutical" includes dietary supplements having health benefits in plants and animals, particularly humans. Examples of such molecules are vitamins, antioxidants, and also certain lipids (e.g., polyunsaturated fatty acids).

The biosynthesis of these molecules in organisms capable of producing them, such as bacteria, has been largely characterized (Ullman's Encyclopedia of Industrial Chemistry, "Vitamins" vol. A27, p. 443–613, VCH: Weinheim, 1996; Michal, G. (1999) Biochemical Pathways: An Atlas of Biochemistry and Molecular Biology, John Wiley & Sons; Ong, A. S., Niki, E. & Packer, L. (1995) "Nutrition, Lipids, Health, and Disease" Proceedings of the UNESCO/Confederation of Scientific and Technological Associations in Malaysia, and the Society for Free Radical Research—Asia, held Sep. 1–3, 1994 at Penang, Malaysia, AOCS Press: Champaign, Ill. X, 374 S).

Thiamin (vitamin $B_1$) is produced by the chemical coupling of pyrimidine and thiazole moieties. Riboflavin (vitamin $B_2$) is synthesized from guanosine-5'-triphosphate (GTP) and ribose-5'-phosphate. Riboflavin, in turn, is utilized for the synthesis of flavin mononucleotide (FMN) and flavin adenine dinucleotide (FAD). The family of compounds collectively termed 'vitamin $B_6$' (e.g., pyridoxine, pyridoxamine, pyridoxa-5'-phosphate, and the commercially used pyridoxin hydrochloride) are all derivatives of the common structural unit, 5-hydroxy-6-methylpyridine. Pantothenate (pantothenic acid, (R)-(+)-N-(2,4-dihydroxy-3,3-dimethyl-1-oxobutyl)-β-alanine) can be produced either by chemical synthesis or by fermentation. The final steps in pantothenate biosynthesis consist of the ATP-driven condensation of β-alanine and pantoic acid. The enzymes responsible for the biosynthesis steps for the conversion to pantoic acid, to β-alanine and for the condensation to panthotenic acid are known. The metabolically active form of pantothenate is Coenzyme A, for which the biosynthesis proceeds in 5 enzymatic steps. Pantothenate, pyridoxal-5'-phosphate, cysteine and ATP are the precursors of Coenzyme A. These enzymes not only catalyze the formation of panthothante, but also the production of (R)-pantoic acid, (R)-pantolacton, (R)-panthenol (provitamin $B_5$), pantetheine (and its derivatives) and coenzyme A.

Biotin biosynthesis from the precursor molecule pimeloyl-CoA in microorganisms has been studied in detail and several of the genes involved have been identified. Many of the corresponding proteins have been found to also be involved in Fe-cluster synthesis and are members of the nifS class of proteins. Lipoic acid is derived from octanoic acid, and serves as a coenzyme in energy metabolism, where it becomes part of the pyruvate dehydrogenase complex and the α-ketoglutarate dehydrogenase complex. The folates are a group of substances which are all derivatives of folic acid, which is turn is derived from L-glutamic acid, p-aminobenzoic acid and 6-methylpterin. The biosynthesis of folic acid and its derivatives, starting from the metabolism intermediates guanosine-5'-triphosphate (GTP), L-glutamic acid and p-amino-benzoic acid has been studied in detail in certain microorganisms.

Corrinoids (such as the cobalamines and particularly vitamin $B_{12}$) and porphyrines belong to a group of chemicals characterized by a tetrapyrole ring system. The biosynthesis of vitamin $B_{12}$ is sufficiently complex that it has not yet been completely characterized, but many of the enzymes and substrates involved are now known. Nicotinic acid (nicotinate), and nicotinamide are pyridine derivatives which are also termed 'niacin'. Niacin is the precursor of the important coenzymes NAD (nicotinamide adenine dinucleotide) and NADP (nicotinamide adenine dinucleotide phosphate) and their reduced forms.

The large-scale production of these compounds has largely relied on cell-free chemical syntheses, though some of these chemicals have also been produced by large-scale culture of microorganisms, such as riboflavin, Vitamin $B_6$, pantothenate, and biotin. Only Vitamin $B_{12}$ is produced solely by fermentation, due to the complexity of its synthesis. In vitro methodologies require significant inputs of materials and time, often at great cost.

C. Purine, Pyrimidine, Nucleoside and Nucleotide Metabolism and Uses

Purine and pyrimidine metabolism genes and their corresponding proteins are important targets for the therapy of tumor diseases and viral infections. The language "purine" or "pyrimidine" includes the nitrogenous bases which are constituents of nucleic acids, co-enzymes, and nucleotides. The term "nucleotide" includes the basic structural units of nucleic acid molecules, which are comprised of a nitrogenous base, a pentose sugar (in the case of RNA, the sugar is ribose; in the case of DNA, the sugar is D-deoxyribose), and phosphoric acid. The language "nucleoside" includes molecules which serve as precursors to nucleotides, but which are lacking the phosphoric acid moiety that nucleotides possess. By inhibiting the biosynthesis of these molecules, or their mobilization to form nucleic acid molecules, it is possible to inhibit RNA and DNA synthesis; by inhibiting this activity in a fashion targeted to cancerous cells, the ability of tumor cells to divide and replicate may be inhibited. Additionally, there are nucleotides which do not form nucleic acid molecules, but rather serve as energy stores (i.e., AMP) or as coenzymes (i.e., FAD and NAD).

Several publications have described the use of these chemicals for these medical indications, by influencing purine and/or pyrimidine metabolism (e.g. Christopherson, R. I. and Lyons, S. D. (1990) "Potent inhibitors of de novo pyrimidine and purine biosynthesis as chemotherapeutic agents." Med. Res. Reviews 10: 505–548). Studies of enzymes involved in purine and pyrimidine metabolism have been focused on the development of new drugs which can be used, for example, as immunosuppressants or antiproliferants (Smith, J. L., (1995) "Enzymes in nucleotide synthesis." Curr. Opin. Struct. Biol. 5: 752–757; (1995) Biochem Soc. Transact. 23: 877–902). However, purine and pyrimidine bases, nucleosides and nucleotides have other utilities: as intermediates in the biosynthesis of several fine chemicals (e.g., thiamine, S-adenosyl-methionine, folates, or riboflavin), as energy carriers for the cell (e.g., ATP or GTP), and for chemicals themselves, commonly used as flavor enhancers (e.g., IMP or GMP) or for several medicinal applications (see, for example, Kuninaka, A. (1996) Nucleotides and Related Compounds in Biotechnology vol. 6, Rehm et al., eds. VCH: Weinheim, p. 561–612). Also, enzymes involved in purine, pyrimidine, nucleoside, or nucleotide metabolism are increasingly serving as targets against which chemicals for crop protection, including fungicides, herbicides and insecticides, are developed.

The metabolism of these compounds in bacteria has been characterized (for reviews see, for example, Zalkin, H. and Dixon, J. E. (1992) "de novo purine nucleotide biosynthesis", in: Progress in Nucleic Acid Research and Molecular Biology, vol. 42, Academic Press:, p. 259–287; and Michal, G. (1999) "Nucleotides and Nucleosides", Chapter 8 in: Biochemical Pathways: An Atlas of Biochemistry and Molecular Biology, Wiley: New York). Purine metabolism has been the subject of intensive research, and is essential to the normal functioning of the cell. Impaired purine metabolism in higher animals can cause severe disease, such as gout. Purine nucleotides are synthesized from ribose-5-phosphate, in a series of steps through the intermediate compound inosine-5'-phosphate (IMP), resulting in the production of guanosine-5'-monophosphate (GMP) or adenosine-5'-monophosphate (AMP), from which the triphosphate forms utilized as nucleotides are readily formed. These compounds are also utilized as energy stores, so their degradation provides energy for many different biochemical processes in the cell. Pyrimidine biosynthesis proceeds by the formation of uridine-5'-monophosphate (UMP) from ribose-5-phosphate. UMP, in turn, is converted to cytidine-5'-triphosphate (CTP). The deoxy- forms of all of these nucleotides are produced in a one step reduction reaction from the diphosphate ribose form of the nucleotide to the diphosphate deoxyribose form of the nucleotide. Upon phosphorylation, these molecules are able to participate in DNA synthesis.

D. Trehalose Metabolism and Uses

Trehalose consists of two glucose molecules, bound in $\alpha$, $\alpha$-1,1 linkage. It is commonly used in the food industry as a sweetener, an additive for dried or frozen foods, and in beverages. However, it also has applications in the pharmaceutical, cosmetics and biotechnology industries (see, for example, Nishimoto et al., (1998) U.S. Pat. No. 5,759,610; Singer, M. A. and Lindquist, S. (1998) Trends Biotech. 16: 460–467; Paiva, C. L. A. and Panek, A. D. (1996) Biotech. Ann. Rev. 2: 293–314; and Shiosaka, M. (1997) J. Japan 172:97–102). Trehalose is produced by enzymes from many microorganisms and is naturally released into the surrounding medium, from which it can be collected using methods known in the art.

II. Membrane Biosynthesis and Transmembrane Transport

Cellular membranes serve a variety of functions in a cell. First and foremost, a membrane differentiates the contents of a cell from the surrounding environment, thus giving integrity to the cell. Membranes may also serve as barriers to the influx of hazardous or unwanted compounds, and also to the efflux of desired compounds. Cellular membranes are by nature impervious to the unfacilitated diffusion of hydrophilic compounds such as proteins, water molecules and ions due to their structure: a bilayer of lipid molecules in which the polar head groups face outwards (towards the exterior and interior of the cell, respectively) and the nonpolar tails face inwards at the center of the bilayer, forming a hydrophobic core (for a general review of membrane structure and function, see Gennis, R. B. (1989) Biomembranes, Molecular Structure and Function, Springer: Heidelberg). This barrier enables cells to maintain a relatively higher concentration of desired compounds and a relatively lower concentration of undesired compounds than are contained within the surrounding medium, since the diffusion of these compounds is effectively blocked by the membrane. However, the membrane also presents an effective barrier to the import of desired compounds and the export of waste molecules. To overcome this difficulty, cellular membranes incorporate many kinds of transporter proteins which are able to facilitate the transmembrane transport of different kinds of compounds. There are two general classes of these transport proteins: pores or channels and transporters. The former are integral membrane proteins, sometimes complexes of proteins, which form a regulated hole through the membrane. This regulation, or 'gating' is generally specific to the molecules to be transported by the pore or channel, rendering these transmembrane constructs selectively permeable to a specific class of substrates; for example, a potassium channel is constructed such that only ions having a like charge and size to that of potassium may pass through. Channel and pore proteins tend to have discrete hydrophobic and hydrophilic domains, such that the hydrophobic face of the protein may associate with the interior of the membrane while the hydrophilic face lines the interior of the channel, thus providing a sheltered hydrophilic environment through which the selected hydrophilic molecule may pass. Many such pores/channels are known in the art, including those for potassium, calcium, sodium, and chloride ions.

This pore and channel-mediated system of facilitated diffusion is limited to very small molecules, such as ions, because pores or channels large enough to permit the passage of whole proteins by facilitated diffusion would be unable to prevent the passage of smaller hydrophilic molecules as well. Transport of molecules by this process is sometimes termed 'facilitated diffusion' since the driving force of a concentration gradient is required for the transport to occur. Permeases also permit facilitated diffusion of larger molecules, such as glucose or other sugars, into the cell when the concentration of these molecules on one side of the membrane is greater than that on the other (also called 'uniport'). In contrast to pores or channels, these integral membrane proteins (often having between 6–14 membrane-spanning α-helices) do not form open channels through the membrane, but rather bind to the target molecule at the surface of the membrane and then undergo a conformational shift such that the target molecule is released on the opposite side of the membrane.

However, cells frequently require the import or export of molecules against the existing concentration gradient ('active transport'), a situation in which facilitated diffusion cannot occur. There are two general mechanisms used by cells for such membrane transport: symport or antiport, and energy-coupled transport such as that mediated by the ABC transporters. Symport and antiport systems couple the movement of two different molecules across the membrane (via permeases having two separate binding sites for the two different molecules); in symport, both molecules are transported in the same direction, while in antiport, one molecule is imported while the other is exported. This is possible energetically because one of the two molecules moves in accordance with a concentration gradient, and this energetically favorable event is permitted only upon concomitant movement of a desired compound against the prevailing concentration gradient. Single molecules may be transported across the membrane against the concentration gradient in an energy-driven process, such as that utilized by the ABC transporters. In this system, the transport protein located in the membrane has an ATP-binding cassette; upon binding of the target molecule, the ATP is converted to ADP+Pi, and the resulting release of energy is used to drive the movement of the target molecule to the opposite face of the membrane, facilitated by the transporter. For more detailed descriptions of all of these transport systems, see: Bamberg, E. et al., (1993) "Charge transport of ion pumps on lipid bilayer membranes", *Q. Rev. Biophys.* 26: 1–25; Findlay, J. B. C. (1991) "Structure and function in membrane transport systems", *Curr. Opin. Struct. Biol.* 1:804–810; Higgins, C. F. (1 992) "ABC transporters from microorganisms to man", *Ann. Rev. Cell Biol.* 8: 67–113; Gennis, R. B. (1989) "Pores, Channels and Transporters", in: Biomembranes, Molecular Structure and Function, Springer: Heidelberg, p. 270–322; and Nikaido, H. and Saier, H. (1992) "Transport proteins in bacteria: common themes in their design", *Science* 258: 936–942, and references contained within each of these references.

The synthesis of membranes is a well-characterized process involving a number of components, the most important of which are lipid molecules. Lipid synthesis may be divided into two parts: the synthesis of fatty acids and their attachment to sn-glycerol-3-phosphate, and the addition or modification of a polar head group. Typical lipids utilized in bacterial membranes include phospholipids, glycolipids, sphingolipids, and phosphoglycerides. Fatty acid synthesis begins with the conversion of acetyl CoA either to malonyl CoA by acetyl CoA carboxylase, or to acetyl-ACP by acetyltransacylase. Following a condensation reaction, these two product molecules together form acetoacetyl-ACP, which is converted by a series of condensation, reduction and dehydration reactions to yield a saturated fatty acid molecule having a desired chain length. The production of unsaturated fatty acids from such molecules is catalyzed by specific desaturases either aerobically, with the help of molecular oxygen, or anaerobically (for reference on fatty acid synthesis, see F. C. Neidhardt et al. (1996) *E. coli* and *Salmonella*. ASM Press: Washington, D.C., p. 612–636 and references contained therein; Lengeler et al. (eds) (1999) Biology of Procaryotes. Thieme: Stuttgart, N.Y., and references contained therein; and Magnuson, K. et al., (1993) *Microbiological Reviews* 57: 522–542, and references contained therein). The cyclopropane fatty acids (CFA) are synthesized by a specific CFA-synthase using SAM as a cosubstrate. Branched chain fatty acids are synthesized from branched chain amino acids that are deaminated to yield branched chain 2-oxo-acids (see Lengeler et al., eds. (1999) Biology of Procaryotes. Thieme: Stuttgart, N.Y., and references contained therein). Another essential step in lipid synthesis is the transfer of fatty acids onto the polar head groups by, for example, glycerol-phosphate-acyltransferases. The combination of various precursor molecules and biosynthetic enzymes results in the production of different fatty acid molecules, which has a profound effect on the composition of the membrane.

III. Elements and Methods of the Invention

The present invention is based, at least in part, on the discovery of novel molecules, referred to herein as MCT nucleic acid and protein molecules, which control the production of cellular membranes in *C. glutamicum* and govern the movement of molecules across such membranes. In one embodiment, the MCT molecules participate in the metabolism of compounds necessary for the construction of cellular membranes in *C. glutamicum*, or in the transport of molecules across these membranes. In a preferred embodiment, the activity of the MCT molecules of the present invention to regulate membrane component production and membrane transport has an impact on the production of a desired fine chemical by this organism. In a particularly preferred embodiment, the MCT molecules of the invention are modulated in activity, such that the *C. glutamicum* metabolic pathways which the MCT proteins of the invention regulate are modulated in yield, production, and/or efficiency of production and the transport of compounds through the membranes is altered in efficiency, which either directly or indirectly modulates the yield, production, and/or efficiency of production of a desired fine chemical by *C. glutamicum*.

The language, "MCT protein" or "MCT polypeptide" includes proteins which participate in the metabolism of compounds necessary for the construction of cellular membranes in *C. glutamicum*, or in the transport of molecules across these membranes. Examples of MCT proteins include those encoded by the MCT genes set forth in Table 1 and Appendix A. The terms "MCT gene" or "MCT nucleic acid sequence" include nucleic acid sequences encoding an MCT protein, which consist of a coding region and also corresponding untranslated 5' and 3' sequence regions. Examples of MCT genes include those set forth in Table 1. The terms "production" or "productivity" are art-recognized and include the concentration of the fermentation product (for example, the desired fine chemical) formed within a given time and a given fermentation volume (e.g., kg product per hour per liter). The term "efficiency of production" includes the time required for a particular level of production to be achieved (for example, how long it takes for the cell to attain a particular rate of output of a fine chemical). The term "yield" or "product/carbon yield" is art-recognized and includes the efficiency of the conversion of the carbon source into the product (i.e., fine chemical). This is generally written as, for example, kg product per kg carbon source. By increasing the yield or production of the compound, the quantity of recovered molecules, or of useful recovered molecules of that compound in a given amount of culture over a given amount of time is increased. The terms "biosynthesis" or a "biosynthetic pathway" are art-recognized and include the synthesis of a compound, preferably an organic compound, by a cell from intermediate compounds in what may be a multistep and highly regulated process. The terms "degradation" or a "degradation pathway" are art-recognized and include the breakdown of a compound, preferably an organic compound, by a cell to degradation products (generally speaking, smaller or less complex molecules) in what may be a multistep and highly regulated process. The language "metabolism" is art-recognized and includes the totality of the biochemical reactions that take place in an organism. The metabolism of a particular compound, then, (e.g., the metabolism of an amino acid such as glycine) comprises the overall biosynthetic, modification, and degradation pathways in the cell related to this compound.

In another embodiment, the MCT molecules of the invention are capable of modulating the production of a desired molecule, such as a fine chemical, in a microorganism such as C. glutamicum. There are a number of mechanisms by which the alteration of an MCT protein of the invention may directly affect the yield, production, and/or efficiency of production of a fine chemical from a C. glutamicum strain incorporating such an altered protein. Those MCT proteins involved in the export of fine chemical molecules from the cell may be increased in number or activity such that greater quantities of these compounds are secreted to the extracellular medium, from which they are more readily recovered. Similarly, those MCT proteins involved in the import of nutrients necessary for the biosynthesis of one or more fine chemicals (e.g., phosphate, sulfate, nitrogen compounds, etc.) may be increased in number or activity such that these precursor, cofactor, or intermediate compounds are increased in concentration within the cell. Further, fatty acids and lipids themselves are desirable fine chemicals; by optimizing the activity or increasing the number of one or more MCT proteins of the invention which participate in the biosynthesis of these compounds, or by impairing the activity of one or more MCT proteins which are involved in the degradation of these compounds, it may be possible to increase the yield, production, and/or efficiency of production of fatty acid and lipid molecules from C. glutamicum.

The mutagenesis of one or more MCT genes of the invention may also result in MCT proteins having altered activities which indirectly impact the production of one or more desired fine chemicals from C. glutamicum. For example, MCT proteins of the invention involved in the export of waste products may be increased in number or activity such that the normal metabolic wastes of the cell (possibly increased in quantity due to the overproduction of the desired fine chemical) are efficiently exported before they are able to damage nucleotides and proteins within the cell (which would decrease the viability of the cell) or to interfere with fine chemical biosynthetic pathways (which would decrease the yield, production, or efficiency of production of the desired fine chemical). Further, the relatively large intracellular quantities of the desired fine chemical may in itself be toxic to the cell, so by increasing the activity or number of transporters able to export this compound from the cell, one may increase the viability of the cell in culture, in turn leading to a greater number of cells in the culture producing the desired fine chemical. The MCT proteins of the invention may also be manipulated such that the relative amounts of different lipid and fatty acid molecules are produced. This may have a profound effect on the lipid composition of the membrane of the cell. Since each type of lipid has different physical properties, an alteration in the lipid composition of a membrane may significantly alter membrane fluidity. Changes in membrane fluidity can impact the transport of molecules across the membrane, as well as the integrity of the cell, both of which have a profound effect on the production of fine chemicals from C. glutamicum in large-scale fermentative culture.

The isolated nucleic acid sequences of the invention are contained within the genome of a Corynebacterium glutamicum strain available through the American Type Culture Collection, given designation ATCC 13032. The nucleotide sequence of the isolated C. glutamicum MCT DNAs and the predicted amino acid sequences of the C. glutamicum MCT proteins are shown in Appendices A and B, respectively. Computational analyses were performed which classified and/or identified these nucleotide sequences as sequences which encode proteins involved in the metabolism of cellular membrane components or proteins involved in the transport of compounds across such membranes.

The present invention also pertains to proteins which have an amino acid sequence which is substantially homologous to an amino acid sequence of Appendix B. As used herein, a protein which has an amino acid sequence which is substantially homologous to a selected amino acid sequence is least about 50% homologous to the selected amino acid sequence, e.g., the entire selected amino acid sequence. A protein which has an amino acid sequence which is substantially homologous to a selected amino acid sequence can also be least about 50–60%, preferably at least about 60–70%, and more preferably at least about 70–80%, 80–90%, or 90–95%, and most preferably at least about 96%, 97%, 98%, 99% or more homologous to the selected amino acid sequence.

The MCT protein or a biologically active portion or fragment thereof of the invention can participate in the metabolism of compounds necessary for the construction of cellular membranes in C. glutamicum, or in the transport of molecules across these membranes, or have one or more of the activities set forth in Table 1.

Various aspects of the invention are described in further detail in the following subsections:

A. Isolated Nucleic Acid Molecules

One aspect of the invention pertains to isolated nucleic acid molecules that encode MCT polypeptides or biologically active portions thereof, as well as nucleic acid fragments sufficient for use as hybridization probes or primers for the identification or amplification of MCT-encoding nucleic acid (e.g., MCT DNA). As used herein, the term "nucleic acid molecule" is intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: at least about 100 nucleotides of sequence upstream from the 5' end of the coding region and at least about nucleotides of sequence downstream from the 3' end of the coding region of the gene. The nucleic acid molecule can be single-stranded or double-stranded, but preferably is double-stranded DNA. An "isolated" nucleic acid molecule is one which is separated from other nucleic acid molecules which are present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. For example, in various embodiments, the isolated MCT nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived (e.g., a *C. glutamicum* cell). Moreover, an "isolated" nucleic acid molecule, such as a DNA molecule, can be substantially free of other cellular material, or culture medium when produced by recombinant techniques, or chemical precursors or other chemicals when chemically synthesized.

A nucleic acid molecule of the present invention, e.g., a nucleic acid molecule having a nucleotide sequence of Appendix A, or a portion thereof, can be isolated using standard molecular biology techniques and the sequence information provided herein. For example, a *C. glutamicum* MCT DNA can be isolated from a *C. glutamicum* library using all or portion of one of the sequences of Appendix A as a hybridization probe and standard hybridization techniques (e.g., as described in Sambrook, J., Fritsh, E. F., and Maniatis, T. *Molecular Cloning: A Laboratory Manual. 2nd, ed.,* Cold Spring Harbor Laboratory, Cold Spring Harbor Laboratory Press, Cold Spring Harbor, N.Y., 1989). Moreover, a nucleic acid molecule encompassing all or a portion of one of the sequences of Appendix A can be isolated by the polymerase chain reaction using oligonucleotide primers designed based upon this sequence (e.g., a nucleic acid molecule encompassing all or a portion of one of the sequences of Appendix A can be isolated by the polymerase chain reaction using oligonucleotide primers designed based upon this same sequence of Appendix A). For example, mRNA can be isolated from normal endothelial cells (e.g., by the guanidinium-thiocyanate extraction procedure of Chirgwin et al. (1979) *Biochemistry* 18: 5294–5299) and DNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon one of the nucleotide sequences shown in Appendix A. A nucleic acid of the invention can be amplified using cDNA or, alternatively, genomic DNA, as a template and appropriate oligonucleotide primers according to standard PCR amplification techniques. The nucleic acid so amplified can be cloned into an appropriate vector and characterized by DNA sequence analysis. Furthermore, oligonucleotides corresponding to an MCT nucleotide sequence can be prepared by standard synthetic techniques, e.g., using an automated DNA synthesizer.

In a preferred embodiment, an isolated nucleic acid molecule of the invention comprises one of the nucleotide sequences shown in Appendix A. The sequences of Appendix A correspond to the *Corynebacterium glutamicum* MCT DNAs of the invention. This DNA comprises sequences encoding MCT proteins (i.e., the "coding region", indicated in each sequence in Appendix A), as well as 5' untranslated sequences and 3' untranslated sequences, also indicated in Appendix A. Alternatively, the nucleic acid molecule can comprise only the coding region of any of the sequences in Appendix A.

For the purposes of this application, it will be understood that each of the sequences set forth in Appendix A has an identifying RXA, RXN, RXS, or RXC number having the designation "RXA", "RXN", "RXS" or "RXC" followed by 5 digits (i.e., RXA02099, RXN03097, RXS00148, or RXC01748). Each of these sequences comprises up to three parts: a 5' upstream region, a coding region, and a downstream region. Each of these three regions is identified by the same RXA, RXN, RXS, or RXC designation to eliminate confusion. The recitation "one of the sequences in Appendix A", then, refers to any of the sequences in Appendix A, which may be distinguished by their differing RXA, RXN, RXS, or RXC designations. The coding region of each of these sequences is translated into a corresponding amino acid sequence, which is set forth in Appendix B. The sequences of Appendix B are identified by the same RXA, RXN, RXS, or RXC designations as Appendix A, such that they can be readily correlated. For example, the amino acid sequences in Appendix B designated RXA02099, RXN03097, RXS00148, and RXC01748 are translations of the coding region of the nucleotide sequences of nucleic acid molecules RXA02099, RXN03097, RXS00148, and RXC01748, respectively, in Appendix A. Each of the RXA, RXN, RXS, and RXC nucleotide and amino acid sequences of the invention has also been assigned a SEQ ID NO, as indicated in Table 1. For example, as set forth in Table 1, the nucleotide sequence of RXA00104 is SEQ ID NO:5, and the amino acid sequence of RXA00104 is SEQ ID NO:6.

Several of the genes of the invention are "F-designated genes". An F-designated gene includes those genes set forth in Table 1 which have an ° 'F' in front of the RXA, RXN, RXS, or RXC designation. For example, SEQ ID NO:11, designated, as indicated on Table 1, as "F RXA02581", is an F-designated gene, as are SEQ ID NOs: 31, 33, and 43 (designated on Table 1 as "F RXA02487", "F RXA02490", and "F RXA02809", respectively).

In one embodiment, the nucleic acid molecules of the present invention are not intended to include those compiled in Table 2. In the case of the dapD gene, a sequence for this gene was published in Wehrmann, A., et al. (1998) *J. Bacteriol.* 180(12): 3159–3165. However, the sequence obtained by the inventors of the present application is significantly longer than the published version. It is believed that the published version relied on an incorrect start codon, and thus represents only a fragment of the actual coding region.

In another preferred embodiment, an isolated nucleic acid molecule of the invention comprises a nucleic acid molecule which is a complement of one of the nucleotide sequences shown in Appendix A, or a portion thereof. A nucleic acid molecule which is complementary to one of the nucleotide sequences shown in Appendix A is one which is sufficiently complementary to one of the nucleotide sequences shown in Appendix A such that it can hybridize to one of the nucleotide sequences shown in Appendix A, thereby forming a stable duplex.

In still another preferred embodiment, an isolated nucleic acid molecule of the invention comprises a nucleotide sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to a nucleotide sequence shown in Appendix A, or a portion thereof. Ranges and identity values intermediate to the above-recited ranges, (e.g., 70–90% identical or 80–95% identical) are also intended to be encompassed by the present invention. For example, ranges of identity values using a combination of any of the above values recited as upper and/or lower limits are intended to be included. In an additional preferred embodiment, an isolated nucleic acid molecule of the invention comprises a nucleotide sequence which hybridizes, e.g., hybridizes under stringent conditions, to one of the nucleotide sequences shown in Appendix A, or a portion thereof.

Moreover, the nucleic acid molecule of the invention can comprise only a portion of the coding region of one of the sequences in Appendix A, for example a fragment which can be used as a probe or primer or a fragment encoding a biologically active portion of an MCT protein. The nucleotide sequences determined from the cloning of the MCT genes from *C. glutamicum* allows for the generation of probes and primers designed for use in identifying and/or cloning MCT homologues in other cell types and organisms, as well as MCT homologues from other Corynebacteria or related species. The probe/primer typically comprises substantially purified oligonucleotide. The oligonucleotide typically comprises a region of nucleotide sequence that hybridizes under stringent conditions to at least about 12, preferably about 25, more preferably about 40, 50 or 75 consecutive nucleotides of a sense strand of one of the sequences set forth in Appendix A, an anti-sense sequence of one of the sequences set forth in Appendix A, or naturally occurring mutants thereof. Primers based on a nucleotide sequence of Appendix A can be used in PCR reactions to clone MCT homologues. Probes based on the MCT nucleotide sequences can be used to detect transcripts or genomic sequences encoding the same or homologous proteins. In preferred embodiments, the probe further comprises a label group attached thereto, e.g. the label group can be a radioisotope, a fluorescent compound, an enzyme, or an enzyme co-factor. Such probes can be used as a part of a diagnostic test kit for identifying cells which misexpress an MCT protein, such as by measuring a level of an MCT-encoding nucleic acid in a sample of cells, e.g., detecting MCT mRNA levels or determining whether a genomic MCT gene has been mutated or deleted.

In one embodiment, the nucleic acid molecule of the invention encodes a protein or portion thereof which includes an amino acid sequence which is sufficiently homologous to an amino acid sequence of Appendix B such that the protein or portion thereof maintains the ability to participate in the metabolism of compounds necessary for the construction of cellular membranes in *C. glutamicum*, or in the transport of molecules across these membranes. As used herein, the language "sufficiently homologous" refers to proteins or portions thereof which have amino acid sequences which include a minimum number of identical or equivalent (e.g. an amino acid residue which has a similar side chain as an amino acid residue in one of the sequences of Appendix B) amino acid residues to an amino acid sequence of Appendix B such that the protein or portion thereof is able to participate in the metabolism of compounds necessary for the construction of cellular membranes in *C. glutamicum*, or in the transport of molecules across these membranes. Protein members of such membrane component metabolic pathways or membrane transport systems, as described herein, may play a role in the production and secretion of one or more fine chemicals. Examples of such activities are also described herein. Thus, "the function of an MCT protein" contributes either directly or indirectly to the yield, production, and/or efficiency of production of one or more fine chemicals. Examples of MCT protein activities are set forth in Table 1.

In another embodiment, the protein is at least about 50–60%, preferably at least about 60–70%, and more preferably at least about 70–80%, 80–90%, 90–95%, and most preferably at least about 96%, 97%, 98%, 99% or more homologous to an entire amino acid sequence of Appendix B.

Portions of proteins encoded by the MCT nucleic acid molecules of the invention are preferably biologically active portions of one of the MCT proteins. As used herein, the term "biologically active portion of an MCT protein" is intended to include a portion, e.g., a domain/motif, of an MCT protein that participates in the metabolism of compounds necessary for the construction of cellular membranes in *C. glutamicum*, or in the transport of molecules across these membranes, or has an activity as set forth in Table 1. To determine whether an MCT protein or a biologically active portion thereof can participate in the metabolism of compounds necessary for the construction of cellular membranes in *C. glutamicum*, or in the transport of molecules across these membranes, an assay of enzymatic activity may be performed. Such assay methods are well known to those of ordinary skill in the art, as detailed in Example 8 of the Exemplification.

Additional nucleic acid fragments encoding biologically active portions of an MCT protein can be prepared by isolating a portion of one of the sequences in Appendix B, expressing the encoded portion of the MCT protein or peptide (e.g., by recombinant expression in vitro) and assessing the activity of the encoded portion of the MCT protein or peptide.

The invention further encompasses nucleic acid molecules that differ from one of the nucleotide sequences shown in Appendix A (and portions thereof) due to degeneracy of the genetic code and thus encode the same MCT protein as that encoded by the nucleotide sequences shown in Appendix A. In another embodiment, an isolated nucleic acid molecule of the invention has a nucleotide sequence encoding a protein having an amino acid sequence shown in Appendix B. In a still further embodiment, the nucleic acid molecule of the invention encodes a full length *C. glutamicum* protein which is substantially homologous to an amino acid sequence of Appendix B (encoded by an open reading frame shown in Appendix A).

It will be understood by one of ordinary skill in the art that in one embodiment the sequences of the invention are not meant to include the sequences of the prior art, such as those Genbank sequences set forth in Tables 2 or 4 which were available prior to the present invention. In one embodiment, the invention includes nucleotide and amino acid sequences having a percent identity to a nucleotide or amino acid sequence of the invention which is greater than that of a sequence of the prior art (e.g., a Genbank sequence (or the protein encoded by such a sequence) set forth in Tables 2 or 4). For example, the invention includes a nucleotide sequence which is greater than and/or at least 38% identical to the nucleotide sequence designated RXA01420 (SEQ ID NO:7), a nucleotide sequence which is greater than and/or at least 43% identical to the nucleotide sequence designated RXA00104 (SEQ ID NO:5), and a nucleotide sequence which is greater than and/or at least 45% identical to the nucleotide sequence designated RXA02173 (SEQ ID NO:25). One of ordinary skill in the art would be able to calculate the lower threshold of percent identity for any given sequence of the invention by examining the GAP-calculated percent identity scores set forth in Table 4 for each of the three top hits for the given sequence, and by subtracting the highest GAP-calculated percent identity from 100 percent. One of ordinary skill in the art will also appreciate that nucleic acid and amino acid sequences having percent identities greater than the lower threshold so calculated (e.g., at least 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more identical) are also encompassed by the invention.

In addition to the *C. glutamicum* MCT nucleotide sequences shown in Appendix A, it will be appreciated by one of ordinary skill in the art that DNA sequence polymorphisms that lead to changes in the amino acid sequences of MCT proteins may exist within a population (e.g., the *C. glutamicum* population). Such genetic polymorphism in the MCT gene may exist among individuals within a population due to natural variation. As used herein, the terms "gene" and "recombinant gene" refer to nucleic acid molecules comprising an open reading frame encoding an MCT protein, preferably a *C. glutamicum* MCT protein. Such natural variations can typically result in 1–5% variance in the nucleotide sequence of the MCT gene. Any and all such nucleotide variations and resulting amino acid polymorphisms in MCT that are the result of natural variation and that do not alter the functional activity of MCT proteins are intended to be within the scope of the invention.

Nucleic acid molecules corresponding to natural variants and non-*C. glutamicum* homologues of the *C. glutamicum* MCT DNA of the invention can be isolated based on their homology to the *C. glutamicum* MCT nucleic acid disclosed herein using the *C. glutamicum* DNA, or a portion thereof, as a hybridization probe according to standard hybridization techniques under stringent hybridization conditions. Accordingly, in another embodiment, an isolated nucleic acid molecule of the invention is at least 15 nucleotides in length and hybridizes under stringent conditions to the nucleic acid molecule comprising a nucleotide sequence of Appendix A. In other embodiments, the nucleic acid is at least 30, 50, 100, 250 or more nucleotides in length. As used herein, the term "hybridizes under stringent conditions" is intended to describe conditions for hybridization and washing under which nucleotide sequences at least 60% homologous to each other typically remain hybridized to each other. Preferably, the conditions are such that sequences at least about 65%, more preferably at least about 70%, and even more preferably at least about 75% or more homologous to each other typically remain hybridized to each other. Such stringent conditions are known to those of ordinary skill in the art and can be found in *Current Protocols in Molecular Biology*, John Wiley & Sons, N.Y. (1989), 6.3.1–6.3.6. A preferred, non-limiting example of stringent hybridization conditions are hybridization in 6×sodium chloride/sodium citrate (SSC) at about 45° C., followed by one or more washes in 0.2×SSC, 0.1% SDS at 50–65° C. Preferably, an isolated nucleic acid molecule of the invention that hybridizes under stringent conditions to a sequence of Appendix A corresponds to a naturally-occurring nucleic acid molecule. As used herein, a "naturally-occurring" nucleic acid molecule refers to an RNA or DNA molecule having a nucleotide sequence that occurs in nature (e.g., encodes a natural protein). In one embodiment, the nucleic acid encodes a natural *C. glutamicum* MCT protein.

In addition to naturally-occurring variants of the MCT sequence that may exist in the population, one of ordinary skill in the art will further appreciate that changes can be introduced by mutation into a nucleotide sequence of Appendix A, thereby leading to changes in the amino acid sequence of the encoded MCT protein, without altering the functional ability of the MCT protein. For example, nucleotide substitutions leading to amino acid substitutions at "non-essential" amino acid residues can be made in a sequence of Appendix A. A "non-essential" amino acid residue is a residue that can be altered from the wild-type sequence of one of the MCT proteins (Appendix B) without altering the activity of said MCT protein, whereas an "essential" amino acid residue is required for MCT protein activity. Other amino acid residues, however, (e.g., those that are not conserved or only semi-conserved in the domain having MCT activity) may not be essential for activity and thus are likely to be amenable to alteration without altering MCT activity.

Accordingly, another aspect of the invention pertains to nucleic acid molecules encoding MCT proteins that contain changes in amino acid residues that are not essential for MCT activity. Such MCT proteins differ in amino acid sequence from a sequence contained in Appendix B yet retain at least one of the MCT activities described herein. In one embodiment, the isolated nucleic acid molecule comprises a nucleotide sequence encoding a protein, wherein the protein comprises an amino acid sequence at least about 50% homologous to an amino acid sequence of Appendix B and is capable of participate in the metabolism of compounds necessary for the construction of cellular membranes in *C. glutamicum*, or in the transport of molecules across these membranes, or has one or more activities set forth in Table 1. Preferably, the protein encoded by the nucleic acid molecule is at least about 50–60% homologous to one of the sequences in Appendix B, more preferably at least about 60–70% homologous to one of the sequences in Appendix B, even more preferably at least about 70–80%, 80–90%, 90–95% homologous to one of the sequences in Appendix B, and most preferably at least about 96%, 97%, 98%, or 99% homologous to one of the sequences in Appendix B.

To determine the percent homology of two amino acid sequences (e.g., one of the sequences of Appendix B and a mutant form thereof) or of two nucleic acids, the sequences are aligned for optimal comparison purposes (e.g., gaps can be introduced in the sequence of one protein or nucleic acid for optimal alignment with the other protein or nucleic acid). The amino acid residues or nucleotides at corresponding amino acid positions or nucleotide positions are then compared. When a position in one sequence (e.g., one of the sequences of Appendix B) is occupied by the same amino acid residue or nucleotide as the corresponding position in the other sequence (e.g., a mutant form of the sequence selected from Appendix B), then the molecules are homologous at that position (i.e., as used herein amino acid or nucleic acid "homology" is equivalent to amino acid or nucleic acid "identity"). The percent homology between the two sequences is a function of the number of identical positions shared by the sequences (i.e., % homology=# of identical positions/total # of positions×100).

An isolated nucleic acid molecule encoding an MCT protein homologous to a protein sequence of Appendix B can be created by introducing one or more nucleotide substitutions, additions or deletions into a nucleotide sequence of Appendix A such that one or more amino acid substitutions, additions or deletions are introduced into the encoded protein. Mutations can be introduced into one of the sequences of Appendix A by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in an MCT protein is preferably replaced with another amino acid residue from the same side chain family. Alternatively, in another embodiment, mutations can be introduced randomly along all or part of an MCT coding sequence, such as by saturation mutagenesis, and the resultant mutants can be screened for an MCT activity described herein to identify mutants that retain MCT activity. Following mutagenesis of one of the sequences of Appendix A, the encoded protein can be expressed recombinantly and the activity of the protein can be determined using, for example, assays described herein (see Example 8 of the Exemplification).

In addition to the nucleic acid molecules encoding MCT proteins described above, another aspect of the invention pertains to isolated nucleic acid molecules which are antisense thereto. An "antisense" nucleic acid comprises a nucleotide sequence which is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire MCT coding strand, or to only a portion thereof. In one embodiment, an antisense nucleic acid molecule is antisense to a "coding region" of the coding strand of a nucleotide sequence encoding an MCT protein. The term "coding region" refers to the region of the nucleotide sequence comprising codons which are translated into amino acid residues (e.g., the entire coding region of SEQ ID NO:5 (RXA00104 in Appendix A) comprises nucleotides 1 to 756). In another embodiment, the antisense nucleic acid molecule is antisense to a "noncoding region" of the coding strand of a nucleotide sequence encoding MCT. The term "noncoding region" refers to 5' and 3' sequences which flank the coding region that are not translated into amino acids (i.e., also referred to as 5' and 3' untranslated regions).

Given the coding strand sequences encoding MCT disclosed herein (e.g., the sequences set forth in Appendix A), antisense nucleic acids of the invention can be designed according to the rules of Watson and Crick base pairing. The antisense nucleic acid molecule can be complementary to the entire coding region of MCT mRNA, but more preferably is an oligonucleotide which is antisense to only a portion of the coding or noncoding region of MCT mRNA. For example, the antisense oligonucleotide can be complementary to the region surrounding the translation start site of MCT mRNA. An antisense oligonucleotide can be, for example, about 5, 10, 15, 20, 25, 30, 35, 40, 45 or 50 nucleotides in length. An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3) w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a cell or generated in situ such that they hybridize with or bind to cellular mRNA and/or genomic DNA encoding an MCT protein to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al. (1987) *Nucleic Acids. Res.* 15:6625–6641). The antisense nucleic acid molecule can also comprise a 2'-o-methylribonucleotide (Inoue et al. (1987) *Nucleic Acids Res.* 15:6131–6148) or a chimeric RNA-DNA analogue (Inoue et al. (1987) *FEBS Lett.* 215:327–330).

In still another embodiment, an antisense nucleic acid of the invention is a ribozyme. Ribozymes are catalytic RNA molecules with ribonuclease activity which are capable of cleaving a single-stranded nucleic acid, such as an mRNA, to which they have a complementary region. Thus, ribozymes (e.g., hammerhead ribozymes (described in Haselhoff and Gerlach (1988) *Nature* 334:585–591)) can be used to catalytically cleave MCT mRNA transcripts to thereby inhibit translation of MCT mRNA. A ribozyme having specificity for an MCT-encoding nucleic acid can be designed based upon the nucleotide sequence of an MCT DNA disclosed herein (i.e., SEQ ID NO. 5 (RXA00104) in Appendix A)). For example, a derivative of a Tetrahymena L-19 IVS RNA can be constructed in which the nucleotide sequence of the active site is complementary to the nucleotide sequence to be cleaved in an MCT-encoding mRNA. See, e.g., Cech et al. U.S. Pat. No. 4,987,071 and Cech et al. U.S. Pat. No. 5,116,742. Alternatively, MCT mRNA can be used to select a catalytic RNA having a specific ribonuclease activity from a pool of RNA molecules. See, e.g., Bartel, D. and Szostak, J. W. (1993) *Science* 261:1411–1418.

Alternatively, MCT gene expression can be inhibited by targeting nucleotide sequences complementary to the regulatory region of an MCT nucleotide sequence (e.g., an MCT promoter and/or enhancers) to form triple helical structures that prevent transcription of an MCT gene in target cells. See generally, Helene, C. (1991) *Anticancer Drug Des.* 6(6): 569–84; Helene, C. et al. (1992) *Ann. N.Y. Acad Sci.* 660:27–36; and Maher, L. J. (1992) *Bioassays* 14(12): 807–15.

B. Recombinant Expression Vectors and Host Cells

Another aspect of the invention pertains to vectors, preferably expression vectors, containing a nucleic acid encoding an MCT protein (or a portion thereof). As used herein, the term "vector" refers to a nucleic acid molecule capable of transporting another nucleic acid to which it has been linked. One type of vector is a "plasmid", which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are -often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel; *Gene Expression Technology: Methods in Enzymology* 185, Academic Press, San Diego, Calif. (1990). Regulatory sequences include those which direct constitutive expression of a nucleotide sequence in many types of host cell and those which direct expression of the nucleotide sequence only in certain host cells. Preferred regulatory sequences are, for example, promoters such as cos-, tac-, trp-, tet-, trp-tet-, lpp-, lac-, lpp-lac-, lacI$^q$-, T7-, T5-, T3-, gal-, trc-, ara-, SP6-, arny, SPO2, $\lambda$-P$_R$- or $\lambda$ P$_L$, which are used preferably in bacteria. Additional regulatory sequences are, for example, promoters from yeasts and fungi, such as ADC1, MF$\alpha$, AC, P-60, CYC1, GAPDH, TEF, rp28, ADH, promoters from plants such as CaMV/35S, SSU, OCS, lib4, usp, STLS1, B33, nos or ubiquitin- or phaseolin-promoters. It is also possible to use artificial promoters. It will be appreciated by one of ordinary skill in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., MCT proteins, mutant forms of MCT proteins, fusion proteins, etc.).

The recombinant expression vectors of the invention can be designed for expression of MCT proteins in prokaryotic or eukaryotic cells. For example, MCT genes can be expressed in bacterial cells such as *C. glutamicum*, insect cells (using baculovirus expression vectors), yeast and other fungal cells (see Romanos, M. A. et al. (1992) "Foreign gene expression in yeast: a review", *Yeast* 8: 423–488; van den Hondel, C. A. M. J. J. et al. (1991) "Heterologous gene expression in filamentous fungi" in: More Gene Manipulations in Fungi, J. W. Bennet & L. L. Lasure, eds., p. 396–428: Academic Press: San Diego; and van den Hondel, C. A. M. J. J. & Punt, P. J. (1991) "Gene transfer systems and vector development for filamentous fungi, in: Applied Molecular Genetics of Fungi, Peberdy, J. F. et al., eds., p. 1–28, Cambridge University Press: Cambridge), algae and multicellular plant cells (see Schmidt, R. and Willmitzer, L. (1988) High efficiency *Agrobacterium tumefaciens*-mediated transformation of *Arabidopsis thaliana* leaf and cotyledon explants" *Plant Cell Rep.:* 583–586), or mammalian cells. Suitable host cells are discussed further in Goeddel, *Gene Expression Technology: Methods in Enzymology* 185, Academic Press, San Diego, Calif. (1990). Alternatively, the recombinant expression vector can be transcribed and translated in vitro, for example using T7 promoter regulatory sequences and T7 polymerase.

Expression of proteins in prokaryotes is most often carried out with vectors containing constitutive or inducible promoters directing the expression of either fusion or non-fusion proteins. Fusion vectors add a number of amino acids to a protein encoded therein, usually to the amino terminus of the recombinant protein but also to the C-terminus or fused within suitable regions in the proteins. Such fusion vectors typically serve three purposes: 1) to increase expression of recombinant protein; 2) to increase the solubility of the recombinant protein; and 3) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith, D. B. and Johnson, K. S. (1988) *Gene* 67:31–40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. In one embodiment, the coding sequence of the MCT protein is cloned into a pGEX expression vector to create a vector encoding a fusion protein comprising, from the N-terminus to the C-terminus, GST-thrombin cleavage site-X protein. The fusion protein can be purified by affinity chromatography using glutathione-agarose resin. Recombinant MCT protein unfused to GST can be recovered by cleavage of the fusion protein with thrombin.

Examples of suitable inducible non-fusion *E. coli* expression vectors include pTrc (Amann et al, (1988) *Gene* 69:301–315) pLG338, pACYC184, pBR322, pUC18, pUC 19, pKC30, pRep4, pHS1, pHS2, pPLc236, pMBL24, pLG200, pUR290, pIN-III 113-B1, λgt11, pBdCl, and pET 11d (Studier et al, *Gene Expression Technology: Methods in Enzymology* 185, Academic Press, San Diego, Calif. (1990) 60–89; and Pouwels et al., eds. (1985) Cloning Vectors. Elsevier: New York IBSN 0 444 904018). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a coexpressed viral RNA polymerase (T7 gn1). This viral polymerase is supplied by host strains BL21(DE3) or HMS174(DE3) from a resident λ prophage harboring a T7 gn1 gene under the transcriptional control of the lacUV 5 promoter. For transformation of other varieties of bacteria, appropriate vectors may be selected. For example, the plasmids pIJ101, pIJ364, pIJ702 and pIJ361 are known to be useful in transforming Streptomyces, while plasmids pUB110, pC194, or pBD214 are suited for transformation of Bacillus species. Several plasmids of use in the transfer of genetic information into Corynebacterium include pHM1519, pBL1, pSA77, or pAJ667 (Pouwels et al., eds. (1985) Cloning Vectors. Elsevier: New York IBSN 0 444 904018).

One strategy to maximize recombinant protein expression is to express the protein in a host bacteria with an impaired capacity to proteolytically cleave the recombinant protein (Gottesman, S., *Gene Expression Technology: Methods in Enzymology* 185, Academic Press, San Diego, Calif. (1990) 119–128). Another strategy is to alter the nucleic acid sequence of the nucleic acid to be inserted into an expression vector so that the individual codons for each amino acid are those preferentially utilized in the bacterium chosen for expression, such as *C. glutamicum* (Wada et al. (1992) *Nucleic Acids Res.* 20:2111–2118). Such alteration of nucleic acid sequences of the invention can be carried out by standard DNA synthesis techniques.

In another embodiment, the MCT protein expression vector is a yeast expression vector. Examples of vectors for expression in yeast *S. cerevisiae* include pYepSec I (Baldari, et al., (1987) *Embo J.* 6:229–234), 2µ, pAG-1, Yep6, Yep13, pEMBLYe23, pMFa (Kurjan and Herskowitz, (1982) *Cell* 30:933–943), pJRY88 (Schultz et al., (1987) *Gene* 54:113–123), and pYES2 (Invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J. (1991) "Gene transfer systems and vector development for filamentous fungi, in: Applied Molecular Genetics of Fungi, J. F. Peberdy, et al., eds., p. 1–28, Cambridge University Press: Cambridge, and Pouwels et al., eds. (1985) Cloning Vectors. Elsevier: New York (IBSN 0 444 904018).

Alternatively, the MCT proteins of the invention can be expressed in insect cells using baculovirus expression vectors. Baculovirus vectors available for expression of proteins in cultured insect cells (e.g., Sf9 cells) include the pAc series (Smith et al. (1983) *Mol. Cell Biol.* 3:2156–2165) and the pVL series (Lucklow and Summers (1989) *Virology* 170:31–39).

In another embodiment, the MCT proteins of the invention may be expressed in unicellular plant cells (such as algae) or in plant cells from higher plants (e.g., the spermatophytes, such as crop plants). Examples of plant expression vectors include those detailed in: Becker, D., Kemper, E., Schell, J. and Masterson, R. (1992) "New plant binary vectors with selectable markers located proximal to the left border", *Plant Mol. Biol.* 20: 1195–1197; and Bevan, M. W. (1984) "Binary Agrobacterium vectors for plant transformation", *Nucl. Acid. Res.* 12: 8711–8721, and include pLGV23, pGHlac+, pBIN19, pAK2004, and pDH51 (Pouwels et al., eds. (1985) Cloning Vectors. Elsevier: New York IBSN 0 444 904018).

In yet another embodiment, a nucleic acid of the invention is expressed in mammalian cells using a mammalian expression vector. Examples of mammalian expression vectors include pCDM8 (Seed, B. (1987) *Nature* 329:840) and pMT2PC (Kaufman et aL (1987) *EMBO J.* 6:187–195). When used in mammalian cells, the expression vector's control functions are often provided by viral regulatory elements. For example, commonly used promoters are derived from polyoma, Adenovirus 2, cytomegalovirus and Simian Virus 40. For other suitable expression systems for both prokaryotic and eukaryotic cells see chapters 16 and 17 of Sambrook, J., Fritsh, E. F., and Maniatis, T. *Molecular Cloning. A Laboratory Manual. 2nd, ed.,* Cold Spring Harbor Laboratory, Cold Spring Harbor Laboratory Press, Cold Spring Harbor, N.Y., 1989.

In another embodiment, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert et aL (1987) *Genes Dev.* 1:268–277), lymphoid-specific promoters (Calame and Eaton (1988) *Adv. Immunol.* 43:235–275), in particular promoters of T cell receptors (Winoto and Baltimore (1989) *EMBO J.* 8:729–733) and immunoglobulins (Banerji et al. (1983) *Cell* 33:729–740; Queen and Baltimore (1983) *Cell* 33:741–748), neuron-specific promoters (e.g., the neurofilament promoter; Byrne and Ruddle (1989) *PNAS* 86:5473–5477), pancreas-specific promoters (Edlund et al. (1985) *Science* 230:912–916), and mammary gland-specific promoters (e.g., milk whey promoter; U.S. Pat. No. 4,873,316 and European Application Publication No. 264,166). Developmentally-regulated promoters are also encompassed, for example the murine hox promoters (Kessel and Gruss (1990) *Science* 249:374–379) and the cc-fetoprotein promoter (Campes and Tilghman (1989) *Genes Dev.* 3:537–546).

The invention further provides a recombinant expression vector comprising a DNA molecule of the invention cloned into the expression vector in an antisense orientation. That is, the DNA molecule is operatively linked to a regulatory sequence in a manner which allows for expression (by transcription of the DNA molecule) of an RNA molecule which is antisense to MCT mRNA. Regulatory sequences operatively linked to a nucleic acid cloned in the antisense orientation can be chosen which direct the continuous expression of the antisense RNA molecule in a variety of cell types, for instance viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus in which antisense nucleic acids are produced under the control of a high efficiency regulatory region, the activity of which can be determined by the cell type into which the vector is introduced. For a discussion of the regulation of gene expression using antisense genes see Weintraub, H. et al., Antisense RNA as a molecular tool for genetic analysis, *Reviews—Trends in Genetics,* Vol. 1(1) 1986.

Another aspect of the invention pertains to host cells into which a recombinant expression vector of the invention has been introduced. The terms "host cell" and "recombinant host cell" are used interchangeably herein. It is understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

A host cell can be any prokaryotic or eukaryotic cell. For example, an MCT protein can be expressed in bacterial cells such as *C. glutamicum,* insect cells, yeast or mammalian cells (such as Chinese hamster ovary cells (CHO) or COS cells). Other suitable host cells are known to one of ordinary skill in the art. Microorganisms related to *Corynebacterium glutamicum* which may be conveniently used as host cells for the nucleic acid and protein molecules of the invention are set forth in Table 3.

Vector DNA can be introduced into prokaryotic or eukaryotic cells via conventional transformation or transfection techniques. As used herein, the terms "transformation" and "transfection", "conjugation" and "transduction" are intended to refer to a variety of art-recognized techniques for introducing foreign nucleic acid (e.g., linear DNA or RNA (e.g., a linearized vector or a gene construct alone without a vector) or nucleic acid in the form of a vector (e.g., a plasmid, phage, phasmid, phagemid, transposon or other DNA) into a host cell, including calcium phosphate or calcium chloride co-precipitation, DEAE-dextran-mediated transfection, lipofection, natural competence, chemical-mediated transfer, or electroporation. Suitable methods for transforming or transfecting host cells can be found in Sambrook, et al. (*Molecular Cloning. A Laboratory Manual. 2nd, ed.,* Cold Spring Harbor Laboratory, Cold Spring Harbor Laboratory Press, Cold Spring Harbor, N.Y., 1989), and other laboratory manuals.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., resistance to antibiotics) is generally introduced into the host cells along with the gene of interest. Preferred selectable markers include those which confer resistance to drugs, such as G418, hygromycin and methotrexate. Nucleic acid encoding a selectable marker can be introduced into a host cell on the same vector as that encoding an MCT protein or can be introduced on a separate vector. Cells stably transfected with the introduced nucleic acid can be identified by, for example, drug selection (e.g., cells that have incorporated the selectable marker gene will survive, while the other cells die).

To create a homologous recombinant microorganism, a vector is prepared which contains at least a portion of an MCT gene into which a deletion, addition or substitution has been introduced to thereby alter, e.g., functionally disrupt, the MCT gene. Preferably, this MCT gene is a *Corynebacterium glutamicum* MCT gene, but it can be a homologue from a related bacterium or even from a mammalian, yeast, or insect source. In a preferred embodiment, the vector is designed such that, upon homologous recombination, the endogenous MCT gene is functionally disrupted (i.e., no longer encodes a functional protein; also referred to as a "knock out" vector). Alternatively, the vector can be designed such that, upon homologous recombination, the endogenous MCT gene is mutated or otherwise altered but still encodes functional protein (e.g., the upstream regulatory region can be altered to thereby alter the expression of the endogenous MCT protein). In the homologous recombination vector, the altered portion of the MCT gene is flanked at its 5' and 3' ends by additional nucleic acid of the MCT gene to allow for homologous recombination to occur between the exogenous MCT gene carried by the vector and an endogenous MCT gene in a microorganism. The additional flanking MCT nucleic acid is of sufficient length for successful homologous recombination with the endogenous gene. Typically, several kilobases of flanking DNA (both at the 5' and 3' ends) are included in the vector (see e.g., Thomas, K. R., and Capecchi, M. R. (1987) *Cell* 51: 503 for a description of homologous recombination vectors). The vector is introduced into a microorganism (e.g., by electroporation) and cells in which the introduced MCT gene has homologously recombined with the zendogenous MCT gene are selected, using art-known techniques.

In another embodiment, recombinant microorganisms can be produced which contain selected systems which allow for regulated expression of the introduced gene. For example, inclusion of an MCT gene on a vector placing it under control of the lac operon permits expression of the MCT gene only in the presence of IPTG. Such regulatory systems are well known in the art.

In another embodiment, an endogenous MCT gene in a host cell is disrupted (e.g., by homologous recombination or other genetic means known in the art) such that expression of its protein product does not occur. In another embodiment, an endogenous or introduced MCT gene in a host cell has been altered by one or more point mutations, deletions, or inversions, but still encodes a functional MCT protein. In still another embodiment, one or more of the regulatory regions (e.g., a promoter, repressor, or inducer) of an MCT gene in a microorganism has been altered (e.g., by deletion, truncation, inversion, or point mutation) such that the expression of the MCT gene is modulated. One of ordinary skill in the art will appreciate that host cells containing more than one of the described MCT gene and protein modifications may be readily produced using the methods of the invention, and are meant to be included in the present invention.

A host cell of the invention, such as a prokaryotic or eukaryotic host cell in culture, can be used to produce (i.e., express) an MCT protein. Accordingly, the invention further provides methods for producing MCT proteins using the host cells of the invention. In one embodiment, the method comprises culturing the host cell of invention (into which a recombinant expression vector encoding an MCT protein has been introduced, or into which genome has been introduced a gene encoding a wild-type or altered MCT protein) in a suitable medium until MCT protein is produced. In another embodiment, the method further comprises isolating MCT proteins from the medium or the host cell.

C. Isolated MCT Proteins

Another aspect of the invention pertains to isolated MCT proteins, and biologically active portions thereof. An "isolated" or "purified" protein or biologically active portion thereof is substantially free of cellular material when produced by recombinant DNA techniques, or chemical precursors or other chemicals when chemically synthesized. The language "substantially free of cellular material" includes preparations of MCT protein in which the protein is separated from cellular components of the cells in which it is naturally or recombinantly produced. In one embodiment, the language "substantially free of cellular material" includes preparations of MCT protein having less than about 30% (by dry weight) of non-MCT protein (also referred to herein as a "contaminating protein"), more preferably less than about 20% of non-MCT protein, still more preferably less than about 10% of non-MCT protein, and most preferably less than about 5% non-MCT protein. When the MCT protein or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations of MCT protein in which the protein is separated from chemical precursors or other chemicals which are involved in the synthesis of the protein. In one embodiment, the language "substantially free of chemical precursors or other chemicals" includes preparations of MCT protein having less than about 30% (by dry weight) of chemical precursors or non-MCT chemicals, more preferably less than about 20% chemical precursors or non-MCT chemicals, still more preferably less than about 10% chemical precursors or non-MCT chemicals, and most preferably less than about 5% chemical precursors or non-MCT chemicals. In preferred embodiments, isolated proteins or biologically active portions thereof lack contaminating proteins from the same organism from which the MCT protein is derived. Typically, such proteins are produced by recombinant expression of, for example, a C. glutamicum MCT protein in a microorganism such as C. glutamicum.

An isolated MCT protein or a portion thereof of the invention can participate in the metabolism of compounds necessary for the construction of cellular membranes in C. glutamicum, or in the transport of molecules across these membranes, or has one or more of the activities set forth in Table 1. In preferred embodiments, the protein or portion thereof comprises an amino acid sequence which is sufficiently homologous to an amino acid sequence of Appendix B such that the protein or portion thereof maintains the ability participate in the metabolism of compounds necessary for the construction of cellular membranes in C. glutamicum, or in the transport of molecules across these membranes. The portion of the protein is preferably a biologically active portion as described herein. In another preferred embodiment, an MCT protein of the invention has an amino acid sequence shown in Appendix B. In yet another preferred embodiment, the MCT protein has an amino acid sequence which is encoded by a nucleotide sequence which hybridizes, e.g., hybridizes under stringent conditions, to a nucleotide sequence of Appendix A. In still another preferred embodiment, the MCT protein has an amino acid sequence which is encoded by a nucleotide sequence that is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to one of the nucleic acid sequences of Appendix A, or a portion thereof. Ranges and identity values intermediate to the above-recited values, (e.g., 70–90% identical or 80–95% identical) are also intended to be encompassed by the present invention. For example, ranges of identity values using a combination of any of the above values recited as upper and/or lower limits are intended to be included. The preferred MCT proteins of the present invention also preferably possess at least one of the MCT activities described herein. For example, a preferred MCT protein of the present invention includes an amino acid sequence encoded by a nucleotide sequence which hybridizes, e.g., hybridizes under stringent conditions, to a nucleotide sequence of Appendix A, and which can participate in the metabolism of compounds necessary for the construction of cellular membranes in C. glutamicum, or in the transport of molecules across these membranes, or which has one or more of the activities set forth in Table 1.

In other embodiments, the MCT protein is substantially homologous to an amino acid sequence of Appendix B and retains the functional activity of the protein of one of the sequences of Appendix B yet differs in amino acid sequence due to natural variation or mutagenesis, as described in detail in subsection I above. Accordingly, in another embodiment, the MCT protein is a protein which comprises an amino acid sequence which is at least about 50%, 51%, 52%, 53%, 54%, 55%, 56%, 57%, 58%, 59%, or 60%, preferably at least about 61%, 62%, 63%, 64%, 65%, 66%, 67%, 68%, 69%, or 70%, more preferably at least about 71%, 72%, 73%, 74%, 75%, 76%, 77%, 78%, 79%, or 80%, 81%, 82%, 83%, 84%, 85%, 86%, 87%, 88%, 89%, or 90%, or 91%, 92%, 93%, 94%, and even more preferably at least about 95%, 96%, 97%, 98%, 99% or more homologous to an entire amino acid sequence of Appendix B and which has at least one of the MCT activities described herein. Ranges and identity values intermediate to the above-recited values, (e.g., 70–90% identical or 80–95% identical) are also intended to be encompassed by the present invention. For example, ranges of identity values using a combination of any of the above values recited as upper and/or lower limits are intended to be included. In another embodiment, the invention pertains to a full length C. glutamicum protein which is substantially homologous to an entire amino acid sequence of Appendix B.

Biologically active portions of an MCT protein include peptides comprising amino acid sequences derived from the amino acid sequence of an MCT protein, e.g., the an amino acid sequence shown in Appendix B or the amino acid sequence of a protein homologous to an MCT protein, which include fewer amino acids than a full length MCT protein or the full length protein which is homologous to an MCT protein, and exhibit at least one activity of an MCT protein. Typically, biologically active portions (peptides, e.g., peptides which are, for example, 5, 10, 15, 20, 30, 35, 36, 37, 38, 39, 40, 50, 100 or more amino acids in length) comprise a domain or motif with at least one activity of an MCT protein. Moreover, other biologically active portions, in which other regions of the protein are deleted, can be prepared by recombinant techniques and evaluated for one or more of the activities described herein. Preferably, the biologically active portions of an MCT protein include one or more selected domains/motifs or portions thereof having biological activity.

MCT proteins are preferably produced by recombinant DNA techniques. For example, a nucleic acid molecule encoding the protein is cloned into an expression vector (as described above), the expression vector is introduced into a host cell (as described above) and the MCT protein is expressed in the host cell. The MCT protein can then be isolated from the cells by an appropriate purification scheme using standard protein purification techniques. Alternative to recombinant expression, an MCT protein, polypeptide, or peptide can be synthesized chemically using standard peptide synthesis techniques. Moreover, native MCT protein can be isolated from cells (e.g., endothelial cells), for example using an anti-MCT antibody, which can be produced by standard techniques utilizing an MCT protein or fragment thereof of this invention.

The invention also provides MCT chimeric or fusion proteins. As used herein, an MCT "chimeric protein" or "fusion protein" comprises an MCT polypeptide operatively linked to a non-MCT polypeptide. An "MCT polypeptide" refers to a polypeptide having an amino acid sequence corresponding to an MCT protein, whereas a "non-MCT polypeptide" refers to a polypeptide having an amino acid sequence corresponding to a protein which is not substantially homologous to the MCT protein, e.g., a protein which is different from the MCT protein and which is derived from the same or a different organism. Within the fusion protein, the term "operatively linked" is intended to indicate that the MCT polypeptide and the non-MCT polypeptide are fused in-frame to each other. The non-MCT polypeptide can be fused to the N-terminus or C-terminus of the MCT polypeptide. For example, in one embodiment the fusion protein is a GST-MCT fusion protein in which the MCT sequences are fused to the C-termninus of the GST sequences. Such fusion proteins can facilitate the purification of recombinant MCT proteins. In another embodiment, the fusion protein is an MCT protein containing a heterologous signal sequence at its N-terminus. In certain host cells (e.g., mammalian host cells), expression and/or secretion of an MCT protein can be increased through use of a heterologous signal sequence.

Preferably, an MCT chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining, and enzymatic ligation. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and reamplified to generate a chimeric gene sequence (see, for example, Current Protocols in Molecular Biology, eds. Ausubel et al. John Wiley & Sons: 1992). Moreover, many expression vectors are commercially available that already encode a fusion moiety (e.g., a GST polypeptide). An MCT-encoding nucleic acid can be cloned into such an expression vector such that the fusion moiety is linked in-frame to the MCT protein.

Homologues of the MCT protein can be generated by mutagenesis, e.g., discrete point mutation or truncation of the MCT protein. As used herein, the term "homologue" refers to a variant form of the MCT protein which acts as an agonist or antagonist of the activity of the MCT protein. An agonist of the MCT protein can retain substantially the same, or a subset, of the biological activities of the MCT protein. An antagonist of the MCT protein can inhibit one or more of the activities of the naturally occurring form of the MCT protein, by, for example, competitively binding to a downstream or upstream member of the cell membrane component metabolic cascade which includes the MCT protein, or by binding to an MCT protein which mediates transport of compounds across such membranes, thereby preventing translocation from taking place.

In an alternative embodiment, homologues of the MCT protein can be identified by screening combinatorial libraries of mutants, e.g., truncation mutants, of the MCT protein for MCT protein agonist or antagonist activity. In one embodiment, a variegated library of MCT variants is generated by combinatorial mutagenesis at the nucleic acid level and is encoded by a variegated gene library. A variegated library of MCT variants can be produced by, for example, enzymatically ligating a mixture of synthetic oligonucleotides into gene sequences such that a degenerate set of potential MCT sequences is expressible as individual polypeptides, or alternatively, as a set of larger fusion proteins (e.g., for phage display) containing the set of MCT sequences therein. There are a variety of methods which can be used to produce libraries of potential MCT homologues from a degenerate oligonucleotide sequence. Chemical synthesis of a degenerate gene sequence can be performed in an automatic DNA synthesizer, and the synthetic gene then ligated into an appropriate expression vector. Use of a degenerate set of genes allows for the provision, in one mixture, of all of the sequences encoding the desired set of potential MCT sequences. Methods for synthesizing degenerate oligonucleotides are known in the art (see, e.g., Narang, S. A. (1983) *Tetrahedron* 39:3; Itakura et al. (1984) *Annu. Rev. Biochem.* 53:323; Itakura et al. (1984) *Science* 198:1056; Ike et al. (1983) *Nucleic Acid Res.* 11:477.

In addition, libraries of fragments of the MCT protein coding can be used to generate a variegated population of MCT fragments for screening and subsequent selection of homologues of an MCT protein. In one embodiment, a library of coding sequence fragments can be generated by treating a double stranded PCR fragment of an MCT coding sequence with a nuclease under conditions wherein nicking occurs only about once per molecule, denaturing the double stranded DNA, renaturing the DNA to form double stranded DNA which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the MCT protein.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of MCT homologues. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique which enhances the frequency of functional mutants in the libraries, can be used in combination with the screening assays to identify MCT homologues (Arkin and Yourvan (1992) *PNAS* 89:7811–7815; Delgrave et al. (1993) *Protein Engineering* 6(3):327–331).

In another embodiment, cell based assays can be exploited to analyze a variegated MCT library, using methods well known in the art.

D. Uses and Methods of the Invention

The nucleic acid molecules, proteins, protein homologues, fusion proteins, primers, vectors, and host cells described herein can be used in one or more of the following methods: identification of *C. glutamicum* and related organisms; mapping of genomes of organisms related to *C. glutamicum*; identification and localization of *C. glutamicum* sequences of interest; evolutionary studies; determination of MCT protein regions required for function; modulation of an MCT protein activity; modulation of the metabolism of one or more cell membrane components; modulation of the transmembrane transport of one or more compounds; and modulation of cellular production of a desired compound, such as a fine chemical.

The MCT nucleic acid molecules of the invention have a variety of uses. First, they may be used to identify an organism as being *Corynebacterium glutamicum* or a close relative thereof. Also, they may be used to identify the presence of *C. glutamicum* or a relative thereof in a mixed population of microorganisms. The invention provides the nucleic acid sequences of a number of *C. glutamicum* genes; by probing the extracted genomic DNA of a culture of a unique or mixed population of microorganisms under stringent conditions with a probe spanning a region of a *C. glutamicum* gene which is unique to this organism, one can ascertain whether this organism is present.

Although *Corynebacterium glutamicum* itself is nonpathogenic, it is related to pathogenic species, such as *Corynebacterium diphtheriae*. *Corynebacterium diphtheriae* is the causative agent of diphtheria, a rapidly developing, acute, febrile infection which involves both local and systemic pathology. In this disease, a local lesion develops in the upper respiratory tract and involves necrotic injury to epithelial cells; the bacilli secrete toxin which is disseminated through this lesion to distal susceptible tissues of the body. Degenerative changes brought about by the inhibition of protein synthesis in these tissues, which include heart, muscle, peripheral nerves, adrenals, kidneys, liver and spleen, result in the systemic pathology of the disease. Diphtheria continues to have high incidence in many parts of the world, including Africa, Asia, Eastern Europe and the independent states of the former Soviet Union. An ongoing epidemic of diphtheria in the latter two regions has resulted in at least 5,000 deaths since 1990. In one embodiment, the invention provides a method of identifying the presence or activity of *Cornyebacterium diphtheriae* in a subject. This method includes detection of one or more of the nucleic acid or amino acid sequences of the invention (e.g., the sequences set forth in Appendix A or Appendix B) in a subject, thereby detecting the presence or activity of *Corynebacterium diphtheriae* in the subject. *C. glutamicum* and *C. diphtheriae* are related bacteria, and many of the nucleic acid and protein molecules in *C. glutamicum* are homologous to *C. diphtheriae* nucleic acid and protein molecules, and can therefore be used to detect *C. diphtheriae* in a subject.

The nucleic acid and protein molecules of the invention may also serve as markers for specific regions of the genome. This has utility not only in the mapping of the genome, but also for functional studies of *C. glutamicum* proteins. For example, to identify the region of the genome to which a particular *C. glutamicum* DNA-binding protein binds, the *C. glutamicum* genome could be digested, and the fragments incubated with the DNA-binding protein. Those which bind the protein may be additionally probed with the nucleic acid molecules of the invention, preferably with readily detectable labels; binding of such a nucleic acid molecule to the genome fragment enables the localization of the fragment to the genome map of *C. glutamicum*, and, when performed multiple times with different enzymes, facilitates a rapid determination of the nucleic acid sequence to which the protein binds. Further, the nucleic acid molecules of the invention may be sufficiently homologous to the sequences of related species such that these nucleic acid molecules may serve as markers for the construction of a genomic map in related bacteria, such as *Brevibacterium lactofermentum*.

The MCT nucleic acid molecules of the invention are also useful for evolutionary and protein structural studies. The metabolic and transport processes in which the molecules of the invention participate are utilized by a wide variety of prokaryotic and eukaryotic cells; by comparing the sequences of the nucleic acid molecules of the present invention to those encoding similar enzymes from other organisms, the evolutionary relatedness of the organisms can be assessed. Similarly, such a comparison permits an assessment of which regions of the sequence are conserved and which are not, which may aid in determining those regions of the protein which are essential for the functioning of the enzyme. This type of determination is of value for protein engineering studies and may give an indication of what the protein can tolerate in terms of mutagenesis without losing function.

Manipulation of the MCT nucleic acid molecules of the invention may result in the production of MCT proteins having functional differences from the wild-type MCT proteins. These proteins may be improved in efficiency or activity, may be present in greater numbers in the cell than is usual, or may be decreased in efficiency or activity.

The invention provides methods for screening molecules which modulate the activity of an MCT protein, either by interacting with the protein itself or a substrate or binding partner of the MCT protein, or by modulating the transcription or translation of an MCT nucleic acid molecule of the invention. In such methods, a microorganism expressing one or more MCT proteins of the invention is contacted with one or more test compounds, and the effect of each test compound on the activity or level of expression of the MCT protein is assessed.

There are a number of mechanisms by which the alteration of an MCT protein of the invention may directly affect the yield, production, and/or efficiency of production of a fine chemical from a *C. glutamicum* strain incorporating such an altered protein. Recovery of fine chemical compounds from large-scale cultures of *C. glutamicum* is significantly improved if *C. glutamicum* secretes the desired compounds, since such compounds may be readily purified from the culture medium (as opposed to extracted from the mass of *C. glutamicum* cells). By either increasing the number or the activity of transporter molecules which export fine chemicals from the cell, it may be possible to increase the amount of the produced fine chemical which is present in the extracellular medium, thus permitting greater ease of harvesting and purification. Conversely, in order to efficiently overproduce one or more fine chemicals, increased amounts of the cofactors, precursor molecules, and intermediate compounds for the appropriate biosynthetic pathways are required. Therefore, by increasing the number and/or activity of transporter proteins involved in the import of nutrients, such as carbon sources (i.e., sugars), nitrogen sources (i.e., amino acids, ammonium salts), phosphate, and sulfur, it may be possible to improve the production of a fine chemical, due to the removal of any nutrient supply limitations on the biosynthetic process. Further, fatty acids and lipids are themselves desirable fine chemicals, so by optimizing the activity or increasing the number of one or more MCT proteins of the invention which participate in the biosynthesis of these compounds, or by impairing the activity of one or more MCT proteins which are involved in the degradation of these compounds, it may be possible to increase the yield, production, and/or efficiency of production of fatty acid and lipid molecules from *C. glutamicum*.

The engineering of one or more MCT genes of the invention may also result in MCT proteins having altered activities which indirectly impact the production of one or more desired fine chemicals from *C. glutamicum*. For example, the normal biochemical processes of metabolism result in the production of a variety of waste products (e.g., hydrogen peroxide and other reactive oxygen species) which may actively interfere with these same metabolic processes (for example, peroxynitrite is known to nitrate tyrosine side chains, thereby inactivating some enzymes having tyrosine in the active site (Groves, J. T. (1999) *Curr. Opin. Chem. Biol.* 3(2): 226–235). While these waste 2products are typically excreted, the *C. glutamicum* strains utilized for large-scale fermentative production are optimized for the overproduction of one or more fine chemicals, and thus may produce more waste products than is typical for a wild-type *C. glutamicum*. By optimizing the activity of one or more MCT proteins of the invention which are involved in the export of waste molecules, it may be possible to improve the viability of the cell and to maintain efficient metabolic activity. Also, the presence of high intracellular levels of the desired fine chemical may actually be toxic to the cell, so by increasing the ability of the cell to secrete these compounds, one may improve the viability of the cell.

Further, the MCT proteins of the invention may be manipulated such that the relative amounts of various lipid and fatty acid molecules produced are altered. This may have a profound effect on the lipid composition of the membrane of the cell. Since each type of lipid has different physical properties, an alteration in the lipid composition of a membrane may significantly alter membrane fluidity. Changes in membrane fluidity can impact the transport of molecules across the membrane, which, as previously explicated, may modify the export of waste products or the produced fine chemical or the import of necessary nutrients. Such membrane fluidity changes may also profoundly affect the integrity of the cell; cells with relatively weaker membranes are more vulnerable in the large-scale fermentor environment to mechanical stresses which may damage or kill the cell. By manipulating MCT proteins involved in the production of fatty acids and lipids for membrane construction such that the resulting membrane has a membrane composition more amenable to the environmental conditions extant in the cultures utilized to produce fine chemicals, a greater proportion of the *C. glutamicum* cells should survive and multiply. Greater numbers of *C. glutamicum* cells in a culture should translate into greater yields, production, or efficiency of production of the fine chemical from the culture.

The aforementioned mutagenesis strategies for MCT proteins to result in increased yields of a fine chemical from *C. glutamicum* are not meant to be limiting; variations on these strategies will be readily apparent to one of ordinary skill in the art. Using such strategies, and incorporating the mechanisms disclosed herein, the nucleic acid and protein molecules of the invention may be utilized to generate *C. glutamicum* or related strains of bacteria expressing mutated MCT nucleic acid and protein molecules such that the yield, production, and/or efficiency of production of a desired compound is improved. This desired compound may be any natural product of *C. glutamicum*, which includes the final products of biosynthesis pathways and intermediates of naturally-occurring metabolic pathways, as well as molecules which do not naturally occur in the metabolism of *C. glutamicum*, but which are produced by a *C. glutamicum* strain of the invention.

This invention is further illustrated by the following examples which should not be construed as limiting. The contents of all references, patent applications, patents, published patent applications, Tables, Appendices, and the sequence listing cited throughout this application are hereby incorporated by reference.

EXEMPLIFICATION

EXAMPLE 1

Preparation of Total genomic DNA of *Corynebacterium glutamicum* ATCC 13032

A culture of *Corynebacterium glutamicum* (ATCC 13032) was grown overnight at 30° C. with vigorous shaking in BHI medium (Difco). The cells were harvested by centrifugation, the supernatant was discarded and the cells were resuspended in 5 ml buffer-I (5% of the original volume of the culture—all indicated volumes have been calculated for 100 ml of culture volume). Composition of buffer-I: 140.34 g/l sucrose, 2.46 g/l $MgSO_4 \times 7H_2O$, 10 ml/l $KH_2PO_4$ solution (100 g/l, adjusted to pH 6.7 with KOH), 50 ml/l M12 concentrate (10 g/l $(NH_4)_2SO_4$, g/l NaCl, 2 g/l $MgSO_4 \times 7H_2O$, 0.2 g/l $CaCl_2$, 0.5, g/l yeast extract (Difco), 10 ml/l trace-elements-mix (200 mg/l $FeSO_4 \times H_2O$, 10 mg/l $ZnSO_4 \times 7\ H_2O$, 3 mg/l $MnCl_2 \times 4\ H_2O$, 30 mg/l $H_3BO_3$ 20 mg/l $CoCl_2 \times 6\ H_2O$, 1 mg/l $NiCl_2 \times 6\ H_2O$, 3 mg/l $Na_2MoO_4 \times 2\ H_2O$, 500 mg/l complexing agent (EDTA or critic acid), 100 ml/l vitamins-mix (0.2 mg/l biotin, 0.2 mg/l folic acid, 20 mg/l p-amino benzoic acid, 20 mg/l riboflavin, 40 mg/l ca-panthothenate, 140 mg/l nicotinic acid, 40 mg/l pyridoxole hydrochloride, 200 mg/l myo-inositol). Lysozyme was added to the suspension to a final concentration of 2.5 mg/ml. After an approximately 4 h incubation at 37° C., the cell wall was degraded and the resulting protoplasts are harvested by centrifugation. The pellet was washed once with 5 ml buffer-I and once with 5 ml TE-buffer (10 mM Tris-HCl, 1 mM EDTA, pH 8). The pellet was resuspended in 4 ml TE-buffer and 0.5 ml SDS solution (10%) and 0.5 ml NaCl solution (5 M) are added. After adding of proteinase K to a final concentration of 200 µg/ml, the suspension is incubated for ca. 18 h at 37° C. The DNA was purified by extraction with phenol, phenol-chloroform-isoamylalcohol and chloroform-isoamylalcohol using standard procedures. Then, the DNA was precipitated by adding 1/50 volume of 3 M sodium acetate and 2 volumes of ethanol, followed by a 30 min incubation at −20° C. and a 30 min centrifugation at 12,000 rpm in a high speed centrifuge using a SS34 rotor (Sorvall). The DNA was dissolved in 1 ml TE-buffer containing 20 µg/ml RNaseA and dialysed at 4° C. against 1000 ml TE-buffer for at least 3 hours. During this time, the buffer was exchanged 3 times. To aliquots of 0.4 ml of the dialysed DNA solution, 0.4 ml of 2 M LiCl and 0.8 ml of ethanol are added. After a 30 min incubation at −20° C., the DNA was collected by centrifugation (13,000 rpm, Biofuge Fresco, Heraeus, Hanau, Germany). The DNA pellet was dissolved in TE-buffer. DNA prepared by this procedure could be used for all purposes, including southern blotting or construction of genomic libraries.

EXAMPLE 2

Construction of Genomic Libraries in *Escherichia coli* of *Corynebacterium glutamicum* ATCC13032

Using DNA prepared as described in Example 1, cosmid and plasmid libraries were constructed according to known and well established methods (see e.g., Sambrook, J. et al. (1989) "Molecular Cloning: A Laboratory Manual", Cold Spring Harbor Laboratory Press, or Ausubel, F. M. et al. (1994) "Current Protocols in Molecular Biology", John Wiley & Sons.)

Any plasmid or cosmid could be used. Of particular use were the plasmids pBR322 (Sutcliffe, J. G. (1979) *Proc. Natl. Acad. Sci. USA,* 75:3737–3741); pACYC177 (Change & Cohen (1978) *J. Bacteriol* 134:1141–1156), plasmids of the pBS series (pBSSK+, pBSSK− and others; Stratagene, LaJolla, USA), or cosmids as SuperCosl (Stratagene, LaJolla, USA) or Lorist6 (Gibson, T. J., Rosenthal A. and Waterson, R. H. (1987) *Gene* 53:283–286. Gene libraries specifically for use in *C. glutamicum* may be constructed using plasmid pSL109 (Lee, H.-S. and A. J. Sinskey (1994) *J. Microbiol. Biotechnol.* 4: 256–263).

EXAMPLE 3

DNA Sequencing and Computational Functional Analysis

Genomic libraries as described in Example 2 were used for DNA sequencing according to standard methods, in particular by the chain termination method using ABI377 sequencing machines (see e.g., Fleischman, R. D. el al. (1995) "Whole-genome Random Sequencing and Assembly of Haemophilus Influenzae Rd., *Science,* 269:496–512). Sequencing primers with the following nucleotide sequences were used: 5'-GGAAACAGTATGACCATG-3' (SEQ ID NO:677) or 5'-GTAAAACGACGGCCAGT-3' (SEQ ID NO:678).

EXAMPLE 4

In vivo Mutagenesis

In vivo mutagenesis of *Corynebacterium glutamicum* can be performed by passage of plasmid (or other vector) DNA through *E. coli* or other microorganisms (e.g. Bacillus spp. or yeasts such as *Saccharomyces cerevisiae*) which are impaired in their capabilities to maintain the integrity of their genetic information. Typical mutator strains have mutations in the genes for the DNA repair system (e.g., mutHLS, mutD, mutT, etc.; for reference, see Rupp, W. D. (1 996) DNA repair mechanisms, in: *Escherichia coli* and Salmonella, p. 2277–2294, ASM: Washington.) Such strains are well known to those of ordinary skill in the art. The use of such strains is illustrated, for example, in Greener, A. and Callahan, M. (1994) *Strategies* 7: 32–34.

EXAMPLE 5

DNA Transfer between *Escherichia coli* and *Corynebacterium glutamicum*

Several Corynebacterium and Brevibacterium species contain endogenous plasmids (as e.g., pHM1519 or pBL1) which replicate autonomously (for review see, e.g., Martin, J. F. et al. (1987) *Biotechnology,* 5:137–146). Shuttle vectors for *Escherichia coli* and *Corynebacterium glutamicum* can be readily constructed by using standard vectors for *E. coli* (Sambrook, J. et al. (1989), "Molecular Cloning: A Laboratory Manual", Cold Spring Harbor Laboratory Press or Ausubel, F. M. et al. (1994) "Current Protocols in Molecular Biology", John Wiley & Sons) to which a origin or replication for and a suitable marker from *Corynebacterium glutamicum* is added. Such origins of replication are preferably taken from endogenous plasmids isolated from Corynebacterium and Brevibacterium species. Of particular use as transformation markers for these species are genes for kanamycin resistance (such as those derived from the Tn5 or Tn903 transposons) or chloramphenicol (Winnacker, E. L. (1987) "From Genes to Clones—Introduction to Gene Technology, VCH, Weinheim). There are numerous examples in the literature of the construction of a wide variety of shuttle vectors which replicate in both *E. coli* and *C. glutamicum,* and which can be used for several purposes, including gene over-expression (for reference, see e.g., Yoshihama, M. et al. (1985) *J. Bacteriol.* 162:591–597, Martin J. F. et al. (1 987) *Biotechnology,* 5:137–146 and Eikmanns, B. J. et al. (1991) *Gene,* 102:93–98).

Using standard methods, it is possible to clone a gene of interest into one of the shuttle vectors described above and to introduce such a hybrid vectors into strains of *Corynebacterium glutamicum.* Transformation of *C. glutamicum* can be achieved by protoplast transformation (Kastsumata, R. et al. (1984) *J. Bacteriol.* 159306–311), electroporation (Liebl, E. et al. (1989) *FEMS Microbiol. Letters,* 53:399–303) and in cases where special vectors are used, also by conjugation (as described e.g. in Schäfer, A et al. (1990) *J. Bacteriol.* 172:1663–1666). It is also possible to transfer the shuttle vectors for *C. glutamicum* to *E. coli* by preparing plasmid DNA from *C. glutamicum* (using standard methods well-known in the art) and transforming it into *E. coli.* This transformation step can be performed using standard methods, but it is advantageous to use an Mcr-deficient *E. coli* strain, such as NM522 (Gough & Murray (1983) *J. Mol. Biol.* 166:1–19).

Genes may be overexpressed in *C. glutamicum* strains using plasmids which comprise pCG1 (U.S. Pat. No. 4,617, 267) or fragments thereof, and optionally the gene for kanamycin resistance from TN903 (Grindley, N. D. and Joyce, C. M. (1980) *Proc. Natl. Acad. Sci. USA* 77(12): 7176–7180). In addition, genes may be overexpressed in *C. glutamicum* strains using plasmid pSL109 (Lee, H.-S. and A. J. Sinskey (1994) *J. Microbiol. Biotechnol.* 4: 256–263).

Aside from the use of replicative plasmids, gene overexpression can also be achieved by integration into the genome. Genomic integration in *C. glutamicum* or other Corynebacterium or Brevibacterium species may be accomplished by well-known methods, such as homologous recombination with genomic region(s), restriction endonuclease mediated integration (REMI) (see, e.g., DE Patent 19823834), or through the use of transposons. It is also possible to modulate the activity of a gene of interest by modifying the regulatory regions (e.g., a promoter, a repressor, and/or an enhancer) by sequence modification, insertion, or deletion using site-directed methods (such as homologous recombination) or methods based on random events (such as transposon mutagenesis or REMI). Nucleic acid sequences which function as transcriptional terminators may also be inserted 3' to the coding region of one or more genes of the invention; such terminators are well-known in the art and are described, for example, in Winnacker, E. L. (1987) From Genes to Clones—Introduction to Gene Technology. VCH: Weinheim.

EXAMPLE 6

Assessment of the Expression of the Mutant Protein

Observations of the activity of a mutated protein in a transformed host cell rely on the fact that the mutant protein is expressed in a similar fashion and in a similar quantity to that of the wild-type protein. A useful method to ascertain the level of transcription of the mutant gene (an indicator of the amount of mRNA available for translation to the gene product) is to perform a Northern blot (for reference see, for example, Ausubel et al. (1988) Current Protocols in Molecular Biology, Wiley: New York), in which a primer designed to bind to the gene of interest is labeled with a detectable tag (usually radioactive or chemiluminescent), such that when the total RNA of a culture of the organism is extracted, run on gel, transferred to a stable matrix and incubated with this probe, the binding and quantity of binding of the probe indicates the presence and also the quantity of mRNA for this gene. This information is evidence of the degree of transcription of the mutant gene. Total cellular RNA can be prepared from *Corynebacterium glutamicum* by several methods, all well-known in the art, such as that described in Bormann, E. R. et al. (1992) *Mol. Microbiol.* 6: 317–326.

To assess the presence or relative quantity of protein translated from this mRNA, standard techniques, such as a Western blot, may be employed (see, for example, Ausubel et al. (1988) Current Protocols in Molecular Biology, Wiley: New York). In this process, total cellular proteins are extracted, separated by gel electrophoresis, transferred to a matrix such as nitrocellulose, and incubated with a probe, such as an antibody, which specifically binds to the desired protein. This probe is generally tagged with a chemiluminescent or colorimetric label which may be readily detected. The presence and quantity of label observed indicates the presence and quantity of the desired mutant protein present in the cell.

EXAMPLE 7

Growth of Genetically Modified *Corynebacterium glutamicum*—Media and Culture Conditions Genetically modified Corynebacteria are cultured in synthetic or natural growth media. A number of different growth media for Corynebacteria are both well-known and readily available (Lieb et al. (1989) *Appl. Microbiol. Biotechnol.,* 32:205–210; von der Osten et al. (1998) *Biotechnology Letters,* 11:11–16; Patent DE 4,120,867; Liebl (1992) "The Genus Corynebacterium, in: The Procaryotes, Volume II, Balows, A. et al., eds. Springer-Verlag). These media consist of one or more carbon sources, nitrogen sources, inorganic salts, vitamins and trace elements. Preferred carbon sources are sugars, such as mono-, di-, or polysaccharides. For example, glucose, fructose, mannose, galactose, ribose, sorbose, ribulose, lactose, maltose, sucrose, raffinose, starch or cellulose serve as very good carbon sources. It is also possible to supply sugar to the media via complex compounds such as molasses or other by-products from sugar refinement. It can also be advantageous to supply mixtures of different carbon sources. Other possible carbon sources are alcohols and organic acids, such as methanol, ethanol, acetic acid or lactic acid. Nitrogen sources are usually organic or inorganic nitrogen compounds, or materials which contain these compounds. Exemplary nitrogen sources include ammonia gas or ammonia salts, such as $NH_4Cl$ or $(NH_4)_2SO_4$, $NH_4OH$, nitrates, urea, amino acids or complex nitrogen sources like corn steep liquor, soy bean flour, soy bean protein, yeast extract, meat extract and others.

Inorganic salt compounds which may be included in the media include the chloride-, phosphorous- or sulfate-salts of calcium, magnesium, sodium, cobalt, molybdenum, potassium, manganese, zinc, copper and iron. Chelating compounds can be added to the medium to keep the metal ions in solution. Particularly useful chelating compounds include dihydroxyphenols, like catechol or protocatechuate, or organic acids, such as citric acid. It is typical for the media to also contain other growth factors, such as vitamins or growth promoters, examples of which include biotin, riboflavin, thiamin, folic acid, nicotinic acid, pantothenate and pyridoxin. Growth factors and salts frequently originate from complex media components such as yeast extract, molasses, corn steep liquor and others. The exact composition of the media compounds depends strongly on the immediate experiment and is individually decided for each specific case. Information about media optimization is available in the textbook "Applied Microbiol. Physiology, A Practical Approach (eds. P. M. Rhodes, P. F. Stanbury, IRL Press (1997) pp. 53–73, ISBN 0 19 963577 3). It is also possible to select growth media from commercial suppliers, like standard 1 (Merck) or BHI (grain heart infusion, DIFCO) or others.

All medium components are sterilized, either by heat (20 minutes at 1.5 bar and 121° C.) or by sterile filtration. The components can either be sterilized together or, if necessary, separately. All media components can be present at the beginning of growth, or they can optionally be added continuously or batchwise.

Culture conditions are defined separately for each experiment. The temperature should be in a range between 15° C. and 45° C. The temperature can be kept constant or can be altered during the experiment. The pH of the medium should be in the range of 5 to 8.5, preferably around 7.0, and can be maintained by the addition of buffers to the media. An exemplary buffer for this purpose is a potassium phosphate buffer. Synthetic buffers such as MOPS, HEPES, ACES and others can alternatively or simultaneously be used. It is also possible to maintain a constant culture pH through the addition of NaOH or $NH_4OH$ during growth. If complex medium components such as yeast extract are utilized, the necessity for additional buffers may be reduced, due to the fact that many complex compounds have high buffer capacities. If a fermentor is utilized for culturing the microorganisms, the pH can also be controlled using gaseous ammonia.

The incubation time is usually in a range from several hours to several days. This time is selected in order to permit the maximal amount of product to accumulate in the broth. The disclosed growth experiments can be carried out in a variety of vessels, such as microtiter plates, glass tubes, glass flasks or glass or metal fermentors of different sizes. For screening a large number of clones, the microorganisms should be cultured in microtiter plates, glass tubes or shake flasks, either with or without baffles. Preferably 100 ml shake flasks are used, filled with 10% (by volume) of the required growth medium. The flasks should be shaken on a rotary shaker (amplitude 25 mm) using a speed-range of 100–300 rpm. Evaporation losses can be diminished by the maintenance of a humid atmosphere; alternatively, a mathematical correction for evaporation losses should be performed.

If genetically modified clones are tested, an unmodified control clone or a control clone containing the basic plasmid without any insert should also be tested. The medium is inoculated to an $OD_{600}$ of 0.5–1.5 using cells grown on agar plates, such as CM plates (10 g/l glucose, 2,5 g/l NaCl, 2 g/l urea, 10 g/l polypeptone, 5 g/l yeast extract, 5 g/l meat extract, 22 g/l NaCl, 2 g/l urea, 10 g/l polypeptone, 5 g/l yeast extract, 5 g/l meat extract, 22 g/l agar, pH 6.8 with 2M NaOH) that had been incubated at 30° C. Inoculation of the media is accomplished by either introduction of a saline suspension of *C. glutamicum* cells from CM plates or addition of a liquid preculture of this bacterium.

EXAMPLE 8

In vitro Analysis of the Function of Mutant Proteins

The determination of activities and kinetic parameters of enzymes is well established in the art. Experiments to determine the activity of any given altered enzyme must be tailored to the specific activity of the wild-type enzyme, which is well within the ability of one of ordinary skill in the art. Overviews about enzymes in general, as well as specific details concerning structure, kinetics, principles, methods, applications and examples for the determination of many enzyme activities may be found, for example, in the following references: Dixon, M., and Webb, E. C., (1979) Enzymes. Longmans: London; Fersht, (1985) Enzyme Structure and Mechanism. Freeman: New York; Walsh, (1979) Enzymatic Reaction Mechanisms. Freeman: San Francisco; Price, N. C., Stevens, L. (1982) Fundamentals of Enzymology. Oxford Univ. Press: Oxford; Boyer, P. D., ed. (1983) The Enzymes, $3^{rd}$ ed. Academic Press: New York; Bisswanger, H., (1994) Enzymkinetik, $2^{nd}$ ed. VCH: Weinheim (ISBN 3527300325); Bergmeyer, H. U., Bergmeyer, J., Graβl, M., eds. (1983–1986) Methods of Enzymatic Analysis, $3^{rd}$ ed., vol. I–XII, Verlag Chemie: Weinheim; and Ullmann's Encyclopedia of Industrial Chemistry (1987) vol. A9, "Enzymes". VCH: Weinheim, p. 352–363.

The activity of proteins which bind to DNA can be measured by several well-established methods, such as DNA band-shift assays (also called gel retardation assays). The effect of such proteins on the expression of other molecules can be measured using reporter gene assays (such as that described in Kolmar, H. et al. (1995) *EMBO J.* 14: 3895–3904 and references cited therein). Reporter gene test systems are well known and established for applications in both pro- and eukaryotic cells, using enzymes such as beta-galactosidase, green fluorescent protein, and several others.

The determination of activity of membrane-transport proteins can be performed according to techniques such as those described in Gennis, R. B. (1989) "Pores, Channels and Transporters", in Biomembranes, Molecular Structure and Function, Springer: Heidelberg, p. 85–137; 199–234; and 270–322.

EXAMPLE 9

Analysis of Impact of Mutant Protein on the Production of the Desired Product The effect of the genetic modification in *C. glutamicum* on production of a desired compound (such as an amino acid) can be assessed by growing the modified microorganism under suitable conditions (such as those described above) and analyzing the medium and/or the cellular component for increased production of the desired product (i.e., an amino acid). Such analysis techniques are well known to one of ordinary skill in the art, and include spectroscopy, thin layer chromatography, staining methods of various kinds, enzymatic and microbiological methods, and analytical chromatography such as high performance liquid chromatography (see, for example, Ullman, Encyclopedia of Industrial Chemistry, vol. A2, p. 89–90 and p. 443–613, VCH: Weinheim (1985); Fallon, A. et al., (1987) "Applications of HPLC in Biochemistry" in: Laboratory Techniques in Biochemistry and Molecular Biology, vol. 17; Rehm et al. (1993) *Biotechnology*, vol. 3, Chapter III: "Product recovery and purification", page 469–714, VCH: Weinheim; Belter, P. A. et al. (1988) Bioseparations: downstream processing for biotechnology, John Wiley and Sons; Kennedy, J. F. and Cabral, J. M. S. (1992) Recovery processes for biological materials, John Wiley and Sons; Shaeiwitz, J. A. and Henry, J. D. (1988) Biochemical separations, in: Ulmann's Encyclopedia of Industrial Chemistry, vol. B3, Chapter 11, page 1–27, VCH: Weinheim; and Dechow, F. J. (1989) Separation and purification techniques in biotechnology, Noyes Publications.)

In addition to the measurement of the final product of fermentation, it is also possible to analyze other components of the metabolic pathways utilized for the production of the desired compound, such as intermediates and side-products, to determnine the overall efficiency of production of the compound. Analysis methods include measurements of nutrient levels in the medium (e.g., sugars, hydrocarbons, nitrogen sources, phosphate, and other ions), measurements of biomass composition and growth, analysis of the production of common metabolites of biosynthetic pathways, and measurement of gasses produced during fermentation. Standard methods for these measurements are outlined in Applied Microbial Physiology, A Practical Approach, P. M. Rhodes and P. F. Stanbury, eds., IRL Press, p. 103–129; 131–163; and 165–192 (ISBN: 0199635773) and references cited therein.

EXAMPLE 10

Purification of the Desired Product from *C. glutamicum* Culture

Recovery of the desired product from the *C. glutamicum* cells or supernatant of the above-described culture can be performned by various methods well known in the art. If the desired product is not secreted from the cells, the cells can be harvested from the culture by low-speed centrifugation, the cells can be lysed by standard techniques, such as mechanical force or sonication. The cellular debris is removed by centrifugation, and the supernatant fraction containing the soluble proteins is retained for further purification of the desired compound. If the product is secreted from the *C. glutamicum* cells, then the cells are removed from the culture by low-speed centrifuigation, and the supernate fraction is retained for further purification.

The supernatant fraction from either purification method is subjected to chromatography with a suitable resin, in which the desired molecule is either retained on a chromatography resin while many of the impurities in the sample are not, or where the impurities are retained by the resin while the sample is not. Such chromatography steps may be repeated as necessary, using the same or different chromatography resins. One of ordinary skill in the art would be well-versed in the selection of appropriate chromatography resins and in their most efficacious application for a particular molecule to be purified. The purified product may be concentrated by filtration or ultrafiltration, and stored at a temperature at which the stability of the product is maximized.

There are a wide array of purification methods known to the art and the preceding method of purification is not meant to be limiting. Such purification techniques are described, for example, in Bailey, J. E. & Ollis, D. F. Biochemical Engineering Fundamentals, McGraw-Hill: New York (1986).

The identity and purity of the isolated compounds may be assessed by techniques standard in the art. These include high-performance liquid chromatography (HPLC), spectroscopic methods, staining methods, thin layer chromatography, NIRS, enzymatic assay, or microbiologically. Such analysis methods are reviewed in: Patek el al. (1994) *Appl. Environ. Microbiol.* 60: 133–140; Malakhova et al. (1996) *Biotekhnologiya* 11: 27–32; and Schmidt et al. (1998) *Bioprocess Engineer.* 19: 67–70. Ulmann's Encyclopedia of Industrial Chemistry, (1996) vol. A27, VCH: Weinheim, p. 89–90, p. 521–540, p. 540–547, p. 559–566, 575–581 and p. 581–587; Michal, G. (1999) Biochemical Pathways: An Atlas of Biochemistry and Molecular Biology, John Wiley and Sons; Fallon, A. et al. (1987) Applications of HPLC in Biochemistry in: Laboratory Techniques in Biochemistry and Molecular Biology, vol. 17.

EXAMPLE 11

Analysis of the Gene Sequences of the Invention

The comparison of sequences and determination of percent homology between two sequences are art-known techniques, and can be accomplished using a mathematical algorithm, such as the algorithm of Karlin and Altschul (1990) *Proc. Natl. Acad. Sci. USA* 87:2264–68, modified as in Karlin and Altschul (1993) *Proc. Natl. Acad Sci. USA* 90:5873–77. Such an algorithm is incorporated into the NBLAST and XBLAST programs (version 2.0) of Altschul, et al. (1990)*J. Mol. Biol.* 215:403–10. BLAST nucleotide searches can be performed with the NBLAST program, score=100, wordlength=12 to obtain nucleotide sequences homologous to MCT nucleic acid molecules of the invention. BLAST protein searches can be performed with the XBLAST program, score=50, wordlength=3 to obtain amino acid sequences homologous to MCT protein molecules of the invention. To obtain gapped alignments for comparison purposes, Gapped BLAST can be utilized as described in Altschul et al., (1997) *Nucleic Acids Res.* 25(17): 3389–3402. When utilizing BLAST and Gapped BLAST programs, one of ordinary skill in the art will know how to optimize the parameters of the program (e.g., XBLAST and NBLAST) for the specific sequence being analyzed.

Another example of a mathematical algorithm utilized for the comparison of sequences is the algorithm of Meyers and Miller ((1988) *Comput. Appl. Biosci.* 4:11–17). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used. Additional algorithms for sequence analysis are known in the art, and include ADVANCE and ADAM. described in Torelli and Robotti (1994) *Comput. Appl. Biosci.* 10:3–5; and FASTA, described in Pearson and Lipman (1988) *P.N.A.S.* 85:2444–8.

The percent homology between two amino acid sequences can also be accomplished using the GAP program in the GCG software package (available at http://www.gcg.com), using either a Blosum 62 matrix or a PAM250 matrix, and a gap weight of 12, 10, 8, 6, or 4 and a length weight of 2, 3, or 4. The percent homology between two nucleic acid sequences can be accomplished using the GAP program in the GCG software package, using standard parameters, such as a gap weight of 50 and a length weight of 3.

A comparative analysis of the gene sequences of the invention with those present in Genbank has been performed using techniques known in the art (see, e.g., Bexevanis and Ouellette, eds. (1998) Bioinformatics: A Practical Guide to the Analysis of Genes and Proteins. John Wiley and Sons: New York). The gene sequences of the invention were compared to genes present in Genbank in a three-step process. In a first step, a BLASTN analysis (e.g., a local alignment analysis) was performed for each of the sequences of the invention against the nucleotide sequences present in Genbank, and the top 500 hits were retained for further analysis. A subsequent FASTA search (e.g., a combined local and global alignment analysis, in which limited regions of the sequences are aligned) was performed on these 500 hits. Each gene sequence of the invention was subsequently globally aligned to each of the top three FASTA hits, using the GAP program in the GCG software package (using standard parameters). In order to obtain correct results, the length of the sequences extracted from Genbank were adjusted to the length of the query sequences by methods well-known in the art. The results of this analysis are set forth in Table 4. The resulting data is identical to that which would have been obtained had a GAP (global) analysis alone been performed on each of the genes of the invention in comparison with each of the references in Genbank, but required significantly reduced computational time as compared to such a database-wide GAP (global) analysis. Sequences of the invention for which no alignments above the cutoff values were obtained are indicated on Table 4 by the absence of alignment information. It will further be understood by one of ordinary skill in the art that the GAP alignment homology percentages set forth in Table 4 under the heading "% homology (GAP)" are listed in the European numerical format, wherein a ',' represents a decimal point. For example, a value of "40,345" in this column represents "40.345%".

EXAMPLE 12

Construction and Operation of DNA Microarrays

The sequences of the invention may additionally be used in the construction and application of DNA microarrays (the design, methodology, and uses of DNA arrays are well known in the art, and are described, for example, in Schena, M. et al. (1995) *Science* 270: 467–470; Wodicka, L. et al. (1997) *Nature Biotechnology* 15: 1359–1367; DeSaizieu, A. et al. (1998) *Nature Biotechnology* 16: 45–48; and DeRisi, J. L. et al. (1997) *Science* 278: 680–686).

DNA microarrays are solid or flexible supports consisting of nitrocellulose, nylon, glass, silicone, or other materials. Nucleic acid molecules may be attached to the surface in an ordered manner. After appropriate labeling, other nucleic acids or nucleic acid mixtures can be hybridized to the immobilized nucleic acid molecules, and the label may be used to monitor and measure the individual signal intensities of the hybridized molecules at defined regions. This methodology allows the simultaneous quantification of the relative or absolute amount of all or selected nucleic acids in the applied nucleic acid sample or mixture. DNA microarrays, therefore, permit an analysis of the expression of multiple (as many as 6800 or more) nucleic acids in parallel (see, e.g., Schena, M. (1996) *BioEssays* 18(5): 427–431).

The sequences of the invention may be used to design oligonucleotide primers which are able to amplify defined regions of one or more *C. glutamicum* genes by a nucleic acid amplification reaction such as the polymerase chain reaction. The choice and design of the 5' or 3' oligonucleotide primers or of appropriate linkers allows the covalent attachment of the resulting PCR products to the surface of a support medium described above (and also described, for example, Schena, M. et al. (1995) *Science* 270: 467–470).

Nucleic acid microarrays may also be constructed by in situ oligonucleotide synthesis as described by Wodicka, L. et al. (1997) *Nature Biotechnology* 15: 1359–1367. By photolithographic methods, precisely defined regions of the matrix are exposed to light. Protective groups which are photolabile are thereby activated and undergo nucleotide addition, whereas regions that are masked from light do not undergo any modification. Subsequent cycles of protection and light activation permit the synthesis of different oligonucleotides at defined positions. Small, defined regions of the genes of the invention may be synthesized on microarrays by solid phase oligonucleotide synthesis.

The nucleic acid molecules of the invention present in a sample or mixture of nucleotides may be hybridized to the microarrays. These nucleic acid molecules can be labeled according to standard methods. In brief, nucleic acid molecules (e.g., mRNA molecules or DNA molecules) are labeled by the incorporation of isotopically or fluorescently labeled nucleotides, e.g., during reverse transcription or DNA synthesis. Hybridization of labeled nucleic acids to microarrays is described (e.g., in Schena, M. et al. (1995) supra; Wodicka, L. et al. (1997), supra; and DeSaizieu A. et al. (1998), supra). The detection and quantification of the hybridized molecule are tailored to the specific incorporated label. Radioactive labels can be detected, for example, as described in Schena, M. et al. (1995) supra) and fluorescent labels may be detected, for example, by the method of Shalon et al. (1996) *Genome Research* 6: 639–645).

The application of the sequences of the invention to DNA microarray technology, as described above, permits comparative analyses of different strains of *C. glutamicum* or other Corynebacteria. For example, studies of inter-strain variations based on individual transcript profiles and the identification of genes that are important for specific and/or desired strain properties such as pathogenicity, productivity and stress tolerance are facilitated by nucleic acid array methodologies. Also, comparisons of the profile of expression of genes of the invention during the course of a fermentation reaction are possible using nucleic acid array technology.

EXAMPLE 13

Analysis of the Dynamics of Cellular Protein Populations (Proteomics)

The genes, compositions, and methods of the invention may be applied to study the interactions and dynamics of populations of proteins, termed 'proteomics'. Protein populations of interest include, but are not limited to, the total protein population of *C. glutamicum* (e.g, in comparison with the protein populations of other organisms), those proteins which are active under specific environmental or metabolic conditions (e.g., during fermentation, at high or low temperature, or at high or low pH), or those proteins which are active during specific phases of growth and development.

Protein populations can be analyzed by various well-known techniques, such as gel electrophoresis. Cellular proteins may be obtained, for example, by lysis or extraction, and may be separated from one another using a variety of electrophoretic techniques. Sodium dodecyl sulfate polyacrylamide gel electrophoresis (SDS-PAGE) separates proteins largely on the basis of their molecular weight. Isoelectric focusing polyacrylamide gel electrophoresis (IEF-PAGE) separates proteins by their isoelectric point (which reflects not only the amino acid sequence but also posttranslational modifications of the protein). Another, more preferred method of protein analysis is the consecutive combination of both IEF-PAGE and SDS-PAGE, known as 2-D-gel electrophoresis (described, for example, in Hermann et al. (1998) *Electrophoresis* 19: 3217–3221; Fountoulakis et al. (1998) *Electrophoresis* 19: 1193–1202; Langen et al. (1997) *Electrophoresis* 18: 1184–1192; Antelmann et al. (1997) *Electrophoresis* 18: 1451–1463). Other separation techniques may also be utilized for protein separation, such as capillary gel electrophoresis; such techniques are well known in the art.

Proteins separated by these methodologies can be visualized by standard techniques, such as by staining or labeling. Suitable stains are known in the art, and include Coomassie Brilliant Blue, silver stain, or fluorescent dyes such as Sypro Ruby (Molecular Probes). The inclusion of radioactively labeled amino acids or other protein precursors (e.g., $^{35}$S-methionine, $^{35}$S-cysteine, $^{14}$C-labelled amino acids, $^{15}$N-amino acids, $^{15}$NO$_3$ or $^{15}$NH$_4^+$ or $^{13}$C-labelled amino acids) in the medium of *C. glutamicum* permits the labeling of proteins from these cells prior to their separation. Similarly, fluorescent labels may be employed. These labeled proteins can be extracted, isolated and separated according to the previously described techniques.

Proteins visualized by these techniques can be further analyzed by measuring the amount of dye or label used. The amount of a given protein can be determined quantitatively using, for example, optical methods and can be compared to the amount of other proteins in the same gel or in other gels. Comparisons of proteins on gels can be made, for example, by optical comparison, by spectroscopy, by image scanning and analysis of gels, or through the use of photographic films and screens. Such techniques are well-known in the art.

To determine the identity of any given protein, direct sequencing or other standard techniques may be employed. For example, N- and/or C-terminal amino acid sequencing (such as Edman degradation) may be used, as may mass spectrometry (in particular MALDI or ESI techniques (see, e.g., Langen et al. (1997) *Electrophoresis* 18: 1184–1192)). The protein sequences provided herein can be used for the identification of *C. glutamicum* proteins by these techniques.

The information obtained by these methods can be used to compare patterns of protein presence, activity, or modification between different samples from various biological conditions (e.g., different organisms, time points of fermentation, media conditions, or different biotopes, among others). Data obtained from such experiments alone, or in combination with other techniques, can be used for various applications, such as to compare the behavior of various organisms in a given (e.g., metabolic) situation, to increase the productivity of strains which produce fine chemicals or to increase the efficiency of the production of fine chemicals.

Equivalents

Those of ordinary skill in the art will recognize, or will be able to ascertain using no more than routine experimentation, many equivalents to the specific embodiments of the invention described herein. Such equivalents are intended to be encompassed by the following claims.

TABLE 1

GENES IN THE APPLICATION

| Nucleic Acid SEQ ID NO | Amino Acid SEQ ID NO | Identification Code | Contig. | NT Start | NT Stop | Function |
|---|---|---|---|---|---|---|
| Polyketide Synthesis | | | | | | |
| 1 | 2 | RXN03097 | VV0062 | 3 | 557 | AMMONIUM TRANSPORT SYSTEM |
| 3 | 4 | RXA02099 | GR00630 | 6198 | 6470 | AMMONIUM TRANSPORT SYSTEM |
| 5 | 6 | RXA00104 | GR00014 | 15895 | 16650 | CYSQ PROTEIN, ammonium transport protein |
| 7 | 8 | RXA01420 | GR00416 | 775 | 17 | 4″-MYCAROSYL ISOVALERYL-COA TRANSFERASE (EC 2.—.—.—) |
| 9 | 10 | RXN02581 | VV0098 | 30482 | 28623 | POLYKETIDE SYNTHASE |
| 11 | 12 | F RXA02581 | GR00741 | 1 | 1527 | POLYKETIDE SYNTHASE |
| 13 | 14 | RXA02582 | GR00741 | 1890 | 6719 | PROBABLE POLYKETIDE SYNTHASE CY33820 |
| 15 | 16 | RXA01138 | GR00318 | 1656 | 2072 | ACTINORHODIN POLYKETIDE DIMERASE (EC —.—.—.—) |
| 17 | 18 | RXA01980 | GR00573 | 1470 | 838 | POLYKETIDE CYCLASE |
| 19 | 20 | RXN01007 | VV0021 | 2572 | 866 | FRNA |
| 21 | 22 | RXN00784 | VV0103 | 27531 | 28265 | FRNE |
| Fatty acid and lipid synthesis | | | | | | |
| 23 | 24 | RXA02335 | GR00672 | 550 | 2322 | BIOTIN CARBOXYLASE (EC 6.3.4.14) |
| 25 | 26 | RXA02173 | GR00641 | 7473 | 8924 | ACETYL-COENZYME A CARBOXYLASE CARBOXYL TRANSFERASE SUBUNIT BETA (EC 6.4.1.2) |
| 27 | 28 | RXA01764 | GR00500 | 2178 | 3110 | 3-OXOACYL-[ACYL-CARRIER PROTEIN] REDUCTASE (EC 1.1.1.100) |
| 29 | 30 | RXN02487 | VV0007 | 6367 | 4664 | LONG-CHAIN-FATTY-ACID--COA LIGASE (EC 6.2.1.3) |
| 31 | 32 | F RXA02487 | GR00718 | 4937 | 4650 | LONG-CHAIN-FATTY-ACID--COA LIGASE (EC 6.2.1.3) |
| 33 | 34 | F RXA02490 | GR00720 | 817 | 5 | LONG-CHAIN-FATTY-ACID--COA LIGASE (EC 6.2.1.3) |
| 35 | 36 | RXA01467 | GR00422 | 920 | 1210 | ACYL CARRIER PROTEIN |
| 37 | 38 | RXA00796 | GR00212 | 202 | 5 | Acyl carrier protein phosphodiesterase |
| 39 | 40 | RXA01897 | GR00544 | 617 | 1159 | Acyl carrier protein phosphodiesterase |
| 41 | 42 | RXN02809 | VV0342 | 380 | 6 | Acyl carrier protein phosphodiesterase |
| 43 | 44 | F RXA02809 | GR00790 | 277 | 5 | Acyl carrier protein phosphodiesterase |
| 45 | 46 | RXN00113 | VV0129 | 103 | 5724 | FATTY ACID SYNTHASE (EC 2.3.1.85)[INCLUDES: EC 2.3.1.38; EC 2.3.1.39; EC 2.3.1.41; |
| 47 | 48 | F RXA00113 | GR00017 | 2 | 3295 | FATTY-ACID SYNTHASE (EC 2.3.1.85) |
| 49 | 50 | RXN03111 | VV0084 | 6040 | 5 | FATTY ACID SYNTHASE (EC 2.3.1.85) [INCLUDES: EC 2.3.1.38; EC 2.3.1.39; EC 2.3.1.41; EC 1.1.1.100; EC 4.2.1.61; EC 1.3.1.10; EC 3.1.2.14] |
| 51 | 52 | F RXA00158 | GR00024 | 2088 | 4 | FATTY ACID SYNTHASE (EC 2.3.1.85) |
| 53 | 54 | F RXA00572 | GR00155 | 2 | 3832 | FATTY ACID SYNTHASE (EC 2.3.1.85) |
| 55 | 56 | RXA02582 | GR00741 | 1890 | 6719 | PROBABLE POLYKETIDE SYNTHASE CY338.20 |
| 57 | 58 | RXA02691 | GR00754 | 15347 | 14541 | FATTY ACYL RESPONSIVE REGULATOR |
| 59 | 60 | RXA00880 | GR00242 | 6213 | 8057 | LONG-CHAIN-FATTY-ACID-COA LIGASE (EC 6.2.1.3) |
| 61 | 62 | RXA01060 | GR00296 | 9566 | 10489 | OMEGA-3 FATTY ACID DESATURASE (EC 1.14.99.—) |
| 63 | 64 | RXN01722 | VV0036 | 2938 | 1214 | MEDIUM-CHAIN-FATTY-ACID--COA LIGASE (EC 6.2.1.—) |
| 65 | 66 | F RXA01722 | GR00488 | 5746 | 4022 | MEDIUM-CHAIN-FATTY-ACID-COA LIGASE (EC 6.2.1.—) |
| 67 | 68 | RXA-1644 | GR00456 | 9854 | 8577 | CYCLOPROPANE-FATTY-ACYL-PHOSPHOLIPID SYNTHASE (EC 2.1.1.79) |
| 69 | 70 | RXA02029 | GR00618 | 356 | 1669 | CYCLOPROPANE-FATTY-ACYL-PHOSPHOLIPID SYNTHASE (EC 2.1.1.79) |
| 71 | 72 | RXA01801 | GR00509 | 3396 | 2380 | ENOYL-COA HYDRATASE (EC 4.2.1.17) |

TABLE 1-continued

GENES IN THE APPLICATION

| Nucleic Acid SEQ ID NO | Amino Acid SEQ ID NO | Identification Code | Contig. | NT Start | NT Stop | Function |
|---|---|---|---|---|---|---|
| 73 | 74 | RXN02512 | VV0171 | 16147 | 15185 | LIPID A BIOSYNTHESIS LAUROYL ACYLTRANSFERASE (EC 2.3.1.—) |
| 75 | 76 | F RXA02512 | GR00721 | 3303 | 4259 | LIPID A BIOSYNTHESIS LAUROYL ACYLTRANSFERASE (EC 2.3.1.—) |
| 77 | 78 | RXA00899 | GR00245 | 1599 | 2864 | CADIOLIPIN SYNTHETASE (EC 2.7.8.—) |
| 79 | 80 | RXN00819 | VV0054 | 18127 | 19455 | ACYL-COA DEHYDROGENASE (EC 1.3.99.—) |
| 81 | 82 | F RXA00819 | GR00221 | 18 | 1007 | ACYL-COA DEHYDROGENASE (EC 1.3.99.—) |
| 83 | 84 | F RXA01766 | GR00500 | 4081 | 4371 | ACYL-COA DEHYDROGENASE (EC 1.3.99.—) |
| 85 | 86 | RXN01762 | VV0054 | 15318 | 13783 | LONG-CHAIN-FATTY-ACID–COA LIGASE (EC 6.2.1.3) |
| 87 | 88 | F RXA10762 | GR00500 | 1272 | 10 | LONG-CHAIN-FATTY-ACID–COA LIGASE (EC 6.2.1.3) |
| 89 | 90 | RXA00681 | GR00179 | 3405 | 2662 | 3-OXOACYL-[ACYL-CARRIER PROTEIN] REDUCTASE (EC 1.1.1.100) |
| 91 | 92 | RXA00802 | GR00214 | 3803 | 4516 | 3-OXOACYL-[ACYL-CARRIER PROTEIN] REDUCTASE (EC 1.1.1.100) |
| 93 | 94 | RXA02133 | GR00639 | 3 | 308 | 3-OXOACYL-[ACYL-CARRIER PROTEIN] REDUCTASE (EC 1.1.1.100) |
| 95 | 96 | RXN01114 | VV0182 | 9118 | 10341 | 3-KETOACYL-COA THIOLASE (EC 2.3.1.16) |
| 97 | 98 | F RXA01114 | GR00308 | 2 | 793 | 3-KETOACYL-COA THIOLASE (EC 2.3.1.16) |
| 99 | 100 | RXA01894 | GR00542 | 1622 | 2476 | PHOSPHATIDATE CYTIDYLYLTRANSFERASE (EC 2.7.7.41) |
| 101 | 102 | RXA02599 | GR00742 | 3179 | 3655 | PHOSPHATIDYLGLYCEROPHOSPHATASE B (EC 3.1.3.27) |
| 103 | 104 | RXN02638 | VV0098 | 54531 | 53656 | 1-ACYL-SN-GLYCEROL-3-PHOSPATE ACYLTRANSFERASE (EC 2.3.1.51) |
| 105 | 106 | F RXA02638 | GR00749 | 8 | 511 | 1-ACYL-SN-GLYCEROL-3-PHOSPHATE ACYLTRANSFERASE (EC 2.3.1.51) |
| 107 | 108 | RXA00856 | GR00232 | 720 | 1256 | CDP-DIACYLGLYCEROL–GLYCEROL-3-PHOSPHATE 3-PHOSPHATIDYLTRANSFERASE (EC 2.7.8.5) |
| 109 | 110 | RXA02511 | GR00721 | 2621 | 3277 | CDP-DIACYLGLYCEROL–GLYCEROL-3-PHOSPHATE 3-PHOSPHATIDYLTRANSFERASE (EC 2.7.8.5) |
| 111 | 112 | RXN02836 | VV0102 | 32818 | 33372 | KETOACYL REDUCTASE HETN (EC 1.3.1.—) |
| 113 | 114 | F RXA02836 | GR00827 | 106 | 411 | KETOACYL REDUCTASE HETN (EX 1.3.1.—) |
| 115 | 116 | RXA02578 | GR00740 | 2438 | 3541 | PUTATIVE ACYLTRANSFERASE |
| 117 | 118 | RXA02150 | GR00639 | 18858 | 19658 | 1-ACYL-SN-GLYCEROL-3-PHOSPHATE ACYLTRANSFERASE (EC 2.3.1.51) |
| 119 | 120 | RXA00607 | GR00160 | 1869 | 2249 | POLY(3-HYDROXYALKANOATE) POLYMERASE (EC 2.3.1.—) |
| 121 | 122 | RXA02397 | GR00698 | 1688 | 2683 | POLY-BETA-HYDROXYBUTYRATE POLYMERASE (EC 2.3.1.—) |
| 123 | 124 | RXN03110 | VV0083 | 16568 | 17929 | HYDROXYACYLGLUTATHIONE HYDROLASE (EC 3.1.2.6) |
| 125 | 126 | F RXA00660 | GR00171 | 1027 | 5 | HYDROXYACYLGLUTATHIONE HYDROLASE (EC 3.1.2.6) |
| 127 | 128 | RXA00801 | GR00214 | 3138 | 3770 | HYDROXYACYLGLUTATHIONE HYDROLASE (EC 3.1.2.6) |
| 129 | 130 | RXA00821 | GR00221 | 1469 | 2311 | HYDROXYACYLGLUTATHIONE HYDROLASE (EC 3.1.2.6) |
| 131 | 132 | RXN02966 | VV0143 | 12056 | 13462 | HYDROXYACYLGLUTATHIONE HYDROLASE (EC 3.1.2.6) |
| 133 | 134 | F RXA01833 | GR00517 | 1666 | 260 | HYDROXYACYLGLUTATHIONE HYDROLASE (EC 3.1.2.6) |
| 135 | 136 | RXA01853 | GR00525 | 5561 | 5010 | HYDROXYACYLGLUTATHIONE HYDROLASE (EC 3.1.2.6) |
| 137 | 138 | RXN02424 | VV0116 | 10570 | 11169 | HYDROXYACYLGLUTATHIONE HYDROLASE (EC 3.1.2.6) |

TABLE 1-continued

GENES IN THE APPLICATION

| Nucleic Acid SEQ ID NO | Amino Acid SEQ ID NO | Identification Code | Contig. | NT Start | NT Stop | Function |
|---|---|---|---|---|---|---|
| 139 | 140 | F RXA02424 | GR00706 | 808 | 428 | HYDROXYACYLGLUTATHIONE HYDROLASE (EC 3.1.2.6) |
| 141 | 142 | RXN00419 | VV0112 | 1024 | 266 | ACETOACETYL-COA REDUCTASE (EC 1.1.1.36) |
| 143 | 144 | F RXA00419 | GR00095 | 3 | 464 | ACETOACETYL-COA REDUCTASE (EC 1.1.1.36) |
| 145 | 146 | F RXA00421 | GR00096 | 565 | 723 | ACETOACETYL-COA REDUCTASE (EC 1.1.1.36) |
| 147 | 148 | RXN02923 | VV0088 | 3301 | 2564 | ACETOACETYL-COA REDUCTASE (EC 1.1.1.36) |
| 149 | 150 | RXN02922 | VV0321 | 11407 | 10328 | ACYL-COA DEHYDROGENASE, SHORT-CHAIN SPECIFIC (EC 1.3.99.2) |
| 151 | 152 | RXN03065 | VV0038 | 6237 | 6629 | HOLO-[ACYL-CARRIER PROTEIN] SYNTHASE (EC 2.7.8.7) |
| 153 | 154 | RXN03132 | VV0127 | 39053 | 39472 | POLY-BETA-HYDROXYBUTYRATE POLYMERASE (EC 2.3.1.—) |
| 155 | 156 | RXN03157 | VV0188 | 1607 | 1170 | LIPOPOLYSACCHARIDE CORE BIOSYNTHESIS PROTEIN KDTB |
| 157 | 158 | RXN00934 | VV0171 | 15181 | 14099 | (AE000805) LPS biosynthesis RfbU related protein [*Methanobacterium thermoautotrophicum*] |
| 159 | 160 | RXN00792 | VV0321 | 10328 | 9132 | ACYL-COA DEHYDROGENASE, SHORT-CHAIN SPECIFIC (EC 1.3.99.2) |
| 161 | 162 | RXN00931 | VV0171 | 13011 | 12166 | ACYL-COA THIOESTERASE II (EC 3.1.2.—) |
| 163 | 164 | F RXA00931 | GR00253 | 4959 | 4114 | thioesterase II |
| 165 | 166 | RXN01421 | VV0122 | 16024 | 15638 | ACYLTRANSFERASE (EC 2.3.1.—) |
| 167 | 168 | RXN02342 | VV0078 | 3460 | 4266 | BIOTIN-[ACETYL-COA-CARBOXYLASE] SYNTHETASE (EC 6.3.4.15) |
| 169 | 170 | RXN00563 | VV0038 | 1 | 2739 | FATTY ACID SYNTHASE (EC 2.3.1.38; EC 2.3.1.39; EC 2.3.1.41; EC 1.1.1.100; EC 4.2.1.61; EC 1.3.1.10; EC 3.1.2.14 |
| 171 | 172 | RXN02168 | VV0100 | 2894 | 81 | FATTY ACID SYNTHASE (EC 2.3.1.38; EC 2.3.1.39; EC 2.3.1.41; EC 1.1.1.100; EC 4.2.1.61; EC 1.3.1.10; EC 3.1.2.14] |
| 173 | 174 | RXN01090 | VV0155 | 6483 | 5686 | KETOACYL REDUCTASE HETN (EC 1.3.1.—) |
| 175 | 176 | RXN02062 | VV0222 | 3159 | 1990 | Lipopolysaccharide N-acetylglucosaminyltransferase |
| 177 | 178 | RXN02148 | VV0300 | 16561 | 17703 | Lipopolysaccharide N-acetylglucosaminyltransferase |
| 179 | 180 | RXN02595 | VV0098 | 11098 | 9935 | Lipopolysaccharide N-acetylglucosaminyltransferase |
| 181 | 182 | RXS00148 | VV0167 | 9849 | 12059 | METHYLMALONYL-COA MUTASE ALPHA-SUBUNIT (EC 5.4.99.2) |
| 183 | 184 | RXS00149 | VV0167 | 7995 | 9842 | METHYLMALONYL-COA MUTASE BETA-SUBUNIT (EC 5.4.99.2) |
| 185 | 186 | RXS02106 | VV0123 | 22649 | 21594 | LIPOATE-PROTEIN LIGASE A (EC 6.—.—.—) |
| 187 | 188 | RXS01746 | VV0185 | 934 | 1686 | LIPOATE-PROTEIN LIGASE B (EC 6.—.—.—) |
| 189 | 190 | RXS01747 | VV0185 | 1826 | 2869 | LIPOIC ACID SYNTHETASE |
| 191 | 192 | RXC01748 | VV0185 | 3001 | 3780 | protein involved in lipid metabolism |
| 193 | 194 | RXC00354 | VV0135 | 33604 | 32792 | Cytosolic Protein involved in lipid metabolism |
| 195 | 196 | RXC01749 | VV0185 | 3954 | 5569 | Membrane Spanning Protein involved in lipid metabolism |

Fatty acid degradation

| | | | | | | |
|---|---|---|---|---|---|---|
| 197 | 198 | RXA02268 | GR00655 | 2182 | 3081 | LIPASE (EC 3.1.1.3) |
| 199 | 200 | RXA02269 | GR00655 | 3094 | 4065 | LIPASE (EC 3.1.1.3) |
| 201 | 202 | RXA01614 | GR00449 | 8219 | 7197 | LYSOPHOSPHOLIPASE L2 (EC 3.1.1.5) |
| 203 | 204 | RXA10983 | GR00573 | 3559 | 3053 | LIPASE (EC 3.1.1.3) |
| 205 | 206 | RSN02947 | VV0078 | 1319 | 6 | PROPIONYL-COA CARBOXYLASE BETA CHAIN (EC 6.4.1.3) |
| 207 | 208 | F RXA02320 | GR00667 | 593 | 6 | PROPIONYL-COA CARBOXYLASE BETA CHAIN (EC 6.4.1.3) |

TABLE 1-continued

GENES IN THE APPLICATION

| Nucleic Acid SEQ ID NO | Amino Acid SEQ ID NO | Identification Code | Contig. | NT Start | NT Stop | Function |
|---|---|---|---|---|---|---|
| 209 | 210 | F RXA02851 | GR00851 | 524 | 6 | PROPIONYL-COA CARBOXYLASE BETA CHAIN (EC 6.4.1.3) |
| 211 | 212 | RXN02321 | VV0078 | 3291 | 1663 | PROPIONYL-COA CARBOXYLASE BETA CHAIN (EC 6.4.1.3) |
| 213 | 214 | F RXA02321 | GR00667 | 1380 | 937 | PROPIONYL-COA CARBOXYLASE BETA CHAIN (EC 6.4.1.3) |
| 215 | 216 | F RXA02343 | GR00675 | 1403 | 1816 | PROPIONYL-COA CARBOXYLASE BETA CHAIN (EC 6.4.1.3) |
| 217 | 218 | F RXA02850 | GR00850 | 2 | 493 | PROPIONYL-COA CARBOXYLASE BETA CHAIN (EC 6.4.1.3) |
| 219 | 220 | RXA02583 | GR00741 | 6743 | 8290 | METHYLMALONATE-SEMIALDEHYDE DEHYDROGENASE (ACYLATING) (EC 1.2.1.27) 2-Methyl-3-oxopropanoate:NAD+ oxidoreductase (CoA-propanoylating) |
| 221 | 222 | RXA00870 | GR00239 | 809 | 2320 | LIPOAMIDE DEHYDROGENASE COMPONENT (E3) OF BRANCHED-CHAIN ALPHA-KETO ACID DEHYDROGENASE COMPLEX (EC 1.8.1.4) |
| 223 | 224 | RXA01260 | GR00367 | 2381 | 1200 | LIPOAMIDE DEHYDROGENASE COMPONENT (E3) OF BRANCHED-CHAIN ALPHA-KETO ACID DEHYDROGENASE COMPLEX (EC 1.8.1.4) |
| 225 | 226 | RXA01261 | GR00367 | 2607 | 2437 | ISOVALERYL-COA DEHYDROGENASE (EC 1.3.99.10) |
| 227 | 228 | RXA01136 | GR00318 | 685 | 1116 | PROTEIN VDLD |
| 229 | 230 | RXN00559 | VV0103 | 7568 | 6552 | PROTEIN VDLD |
| 231 | 232 | F RXA00559 | GR00149 | 218 | 6 | Glycerophosphoryl diester phosphodiesterase |
| 233 | 234 | RXA01580 | GR00440 | 707 | 6 | GLYCEROPHOSPHORYL DIESTER PHOSPHODIESTERASE (EC 3.1.4.46) |
| 235 | 236 | RXA02677 | GR00754 | 3119 | 3877 | EXTRACELLULAR LIPASE PRECURSOR (EC 3.1.1.3) |
| 237 | 238 | RXS01166 | VV0117 | 18142 | 16838 | |

Terpenoid biosynthesis

| Nucleic Acid SEQ ID NO | Amino Acid SEQ ID NO | Identification Code | Contig. | NT Start | NT Stop | Function |
|---|---|---|---|---|---|---|
| 239 | 240 | RXA00875 | GR00241 | 2423 | 1857 | ISOPENTENYL-DIPHOSPHATE DELTA-ISOMERASE (EC 5.3.3.2) |
| 241 | 242 | RXA01292 | GR00373 | 1204 | 2388 | PHYTOENE DEHYDROGENASE (EC 1.3.—) |
| 243 | 244 | RXA01293 | GR00373 | 2370 | 2696 | PHYTOENE DEHYDROGENASE (EC 1.3.—) |
| 245 | 246 | RXA02310 | GR00665 | 1132 | 2394 | GERANYLGERANYL HYDROGENASE |
| 247 | 248 | RXA02718 | GR00758 | 18539 | 19585 | GERANYLGERANYL PYROPHOSPHATE SYNTHASE (EC 2.5.1.1) |
| 249 | 250 | RXA01067 | GR00298 | 1453 | 2181 | undecaprenyl-diphosphate synthase (EC 2.5.1.31) |
| 251 | 252 | RXA01269 | GR00367 | 20334 | 19894 | UNDECAPRENYL-PHOSPHATE GALACTOSEPHOSPHOTRANSFERASE (EC 2.7.8.6) |
| 253 | 254 | RXA01205 | GR00346 | 3 | 533 | PUTATIVE UNDECAPRENYL-PHOSPHATE ALPHA-N-ACETYLGLUCOSAMINYLTRANSFERASE (EC 2.4.1.—) |
| 255 | 256 | RXA01576 | GR00438 | 8053 | 8811 | DOLICHYL-PHOSPHATE BETA-GLUCOSYLTRANSFERASE (EC 2.4.1.117) |
| 257 | 258 | RXN02309 | VV0025 | 28493 | 29542 | OCTAPRENYL-DIPHOSPHATE SYNTHASE (EC 2.5.1.—) |
| 259 | 260 | F RXA02309 | GR00665 | 978 | 4 | OCTAPRENYL-DIPHOSPHATE SYNTHASE (EC 2.5.1.—) |
| 261 | 262 | RXN00477 | VV0086 | 38905 | 37262 | PHYTOENE DEHYDROGENASE (EC 1.3.—) |
| 263 | 264 | F RXA00477 | GR00119 | 13187 | 11544 | PHYTOENE DEHYDROGENASE (EC 1.3.—) |
| 265 | 266 | RXA00478 | GR00119 | 14020 | 13190 | PHYTOENE SYNTHASE (EC 2.5.1.—) |
| 267 | 268 | RXA01291 | GR00373 | 345 | 1277 | PHYTOENE SYNTHASE (EC 2.5.1.—) |
| 269 | 270 | RXA00480 | GR00119 | 17444 | 16329 | FARNESYL DIPHOSPHATE SYNTHASE (EC 2.5.1.1) (EC 2.5.1.10) |
| 271 | 272 | RXS01879 | VV0115 | 1505 | 573 | isopentenyl-phosphate kinase (EC 2.7.4.—) |
| 273 | 274 | RXS02023 | VV0160 | 3234 | 4001 | P450 cytochrome,isopentenyltransf, ferridox |
| 275 | 276 | RXS00948 | VV0107 | 4266 | 5384 | 12-oxophytodienoate reductase (EC 1.3.1.42) |
| 277 | 278 | RXS02228 | VV0068 | 1876 | 2778 | TRNA DELTA(2)-ISOPENTENYLPYROPHOSPHATE TRANSFERASE (EC 2.5.1.8) |
| 279 | 280 | RXC01971 | VV0105 | 4545 | 3715 | Metal-Dependent Hydrolase involved in metabolism of terpenoids |
| 281 | 282 | RXC02697 | VV0017 | 31257 | 32783 | membrane protein involved in metabolism of terpenoids |

TABLE 1-continued

GENES IN THE APPLICATION

ABC-Transporter

| Nucleic Acid SEQ ID NO | Amino Acid SEQ ID NO | Identification Code | Contig. | NT Start | NT Stop | Function |
|---|---|---|---|---|---|---|
| 283 | 284 | RXN01946 | VV0228 | 2 | 1276 | Hypothetical ABC Transporter ATP-Binding Protein |
| 285 | 286 | F RXA01946 | GR00559 | 1849 | 575 | (AL021184) ABC transporter ATP binding protein [*Mycobacterium tuberculosis*] |
| 287 | 288 | RXN00164 | VV0232 | 1782 | 94 | Hypothetical ABC Transporter ATP-Binding Protein |
| 289 | 290 | F RXA00164 | GR00025 | 1782 | 94 | Hypothetical ABC Transporter ATP-Binding Protein |
| 291 | 292 | RXN00243 | VV0057 | 28915 | 27899 | , P, G, R ATPase subunits of ABC transporters |
| 293 | 294 | F RXA00243 | GR00037 | 930 | 4 | , P, G, R ATPase subunits of ABC transporters |
| 295 | 296 | RXA00259 | GR00039 | 8469 | 6268 | , P, G, R ATPase subunits of ABC transporters |
| 297 | 298 | RXN00410 | VV0086 | 51988 | 51323 | GLUTAMINE TRANSPORT ATP-BINDING PROTEIN GLNQ |
| 299 | 300 | F RXA00410 | GR00092 | 829 | 164 | , P, G, R ATPase subunits of ABC transporters |
| 301 | 302 | RXN00456 | VV0076 | 6780 | 8156 | , P, G, R ATPase subunits of ABC transporters |
| 303 | 304 | F RXA00456 | GR00114 | 316 | 5 | , P, G, R ATPase subunits of ABC transporters |
| 305 | 306 | F RXA00459 | GR00115 | 1231 | 245 | , P, G, R ATPase subunits of ABC transporters |
| 307 | 308 | RXN01604 | VV0137 | 8117 | 7470 | , P, G, R ATPase subunits of ABC transporters |
| 309 | 310 | F RXA01604 | GR00448 | 2 | 607 | , P, G, R ATPase subunits of ABC transporters |
| 311 | 312 | RXN02547 | VV0057 | 27726 | 25588 | , P, G, R ATPase subunits of ABC transporters |
| 313 | 314 | F RXA02547 | GR00726 | 22055 | 19932 | , P, G, R ATPase subunits of ABC transporters |
| 315 | 316 | RXN02571 | VV0101 | 12331 | 13359 | MALTOSE/MALTODEXTRIN TRANSPORT ATP-BINDING PROTEIN MALK |
| 317 | 318 | F RXA02571 | GR00736 | 1469 | 2497 | , P, G, R ATPase subunits of ABC transporters |
| 319 | 320 | RXN02074 | VV0318 | 12775 | 11153 | TRANSPORT ATP-BINDING PROTEIN CYDD |
| 321 | 322 | F RXA02074 | GR00628 | 5798 | 4176 | , P, G, R ATPase subunits of ABC transporters |
| 323 | 324 | RXA02095 | GR00629 | 14071 | 15474 | , P, G, R ATPase subunits of ABC transporters |
| 325 | 326 | RXA02225 | GR00652 | 3156 | 2275 | , P, G, R ATPase subunits of ABC transporters |
| 327 | 328 | RXA02253 | GR00654 | 20480 | 21406 | , P, G, R ATPase subunits of ABC transporters |
| 329 | 330 | RXN01881 | VV0105 | 529 | 95 | Hypothetical ABC Transporter ATP-Binding Protein |
| 331 | 332 | F RXA01881 | GR00537 | 3092 | 3532 | ATPase components of ABC transporters with duplicated ATPase domains |
| 333 | 334 | RXA00526 | GR00136 | 1353 | 664 | Hypothetical ABC Transporter ATP-Binding Protein |
| 335 | 336 | RXN00733 | VV0132 | 1647 | 2531 | Hypothetical ABC Transporter ATP-Binding Protein |
| 337 | 338 | F RXA00733 | GR00197 | 411 | 4 | Hypothetical ABC Transporter ATP-Binding Protein |
| 339 | 340 | RXA00735 | GR00198 | 849 | 181 | Hypothetical ABC Transporter ATp-Binding Protein |
| 341 | 342 | RXA00878 | GR00242 | 3733 | 1871 | Hypothetical ABC Transporter ATp-Binding Protein |
| 343 | 344 | RXN01191 | VV0169 | 10478 | 12067 | Hypothetical ABC Transporter ATP-Binding Protein |
| 345 | 346 | F RXA01191 | GR00341 | 1571 | 165 | Hypothetical ABC Transporter ATP-Binding Protein |
| 347 | 348 | RXN01212 | VV0169 | 3284 | 4207 | Hypothetical ABC Transporter ATP-Binding Protein |
| 349 | 350 | F RXA01212 | GR00350 | 1 | 813 | Hypothetical ABC Transporter ATP-Binding Protein |
| 351 | 352 | RXA02749 | GR00764 | 4153 | 5028 | Hypothetical ABC Transporter ATP-Binding Protein |
| 353 | 354 | RXA02224 | GR00652 | 2271 | 475 | Hypothetical ABC Transporter ATP-Binding Protein |
| 355 | 356 | RXN01602 | VV0229 | 1109 | 2638 | Hypothetical ABC Transporter ATP-Binding Protein |
| 357 | 358 | RXN02515 | VV0087 | 962 | 1717 | Hypothetical ABC Transporter ATP-Binding Protein |
| 359 | 360 | RXN00525 | VV0079 | 26304 | 27566 | Hypothetical ABC Transporter Permease Protein |
| 361 | 362 | RXN02096 | VV0126 | 20444 | 22135 | Hypothetical ABC Transporter Permease Protein |
| 363 | 364 | RXN00412 | VV0086 | 53923 | 52844 | Hypothetical Amino Acid ABC Transporter ATP-Binding Protein |
| 365 | 366 | RXN00411 | VV0086 | 52844 | 52170 | Hypothetical Amino Acid ABC Transporter Permease Protein |
| 367 | 368 | RXN02614 | VV0313 | 5964 | 5236 | TAURINE TRANSPORT ATP-BINDING PROTEIN TAUB |
| 369 | 370 | RXN02613 | VV0313 | 5223 | 4267 | TAURINE-BINDING PERIPLASMIC PROTEIN PRECURSOR |
| 371 | 372 | RXN00368 | VV0226 | 2300 | 726 | SPERMIDINE/PUTRESCINE TRANSPORT ATP-BINDING PROTEIN POTA |

TABLE 1-continued

GENES IN THE APPLICATION

| Nucleic Acid SEQ ID NO | Amino Acid SEQ ID NO | Identification Code | Contig. | NT Start | NT Stop | Function |
|---|---|---|---|---|---|---|
| 373 | 374 | F RXA00368 | GR00076 | 1 | 579 | SPERMIDINE/PUTRESCINE TRANSPORT ATP-BINDING PROTEIN POTA |
| 375 | 376 | F RXA00370 | GR00077 | 6 | 803 | SPERMIDINE/PUTRESCINE TRANSPORT ATP-BINDING PROTEIN POTA |
| 377 | 378 | RXN01285 | VV0215 | 1780 | 1055 | FERRIC ENTEROBACTIN TRANSPORT ATP-BINDING PROTEIN FEPC |
| 379 | 380 | RXN00523 | VV0194 | 1363 | 338 | FERRIC ENTEROBACTIN TRANSPORT PROTEIN FEPG |
| 381 | 382 | RXN01142 | VV0077 | 5805 | 6302 | NITRATE TRANSPORT ATP-BINDING PROTEIN NRTD |
| 383 | 384 | RXN01141 | VV0077 | 4644 | 5468 | NITRATE TRANSPORT PROTEIN NRTA |
| 385 | 386 | RXN01002 | VV0106 | 8858 | 8055 | PHOSPHONATES TRANSPORT ATP-BINDING PROTEIN PHNC |
| 387 | 388 | RXN01000 | VV0106 | 7252 | 6407 | PHOSPHONATES TRANSPORT SYSTEM PERMEASE PROTEIN PHNE |
| 389 | 390 | RXN01732 | VV0106 | 9944 | 8895 | PHOSPHONATES-BINDING PERIPLASMIC PROTEIN PRECURSOR |
| 391 | 392 | RXN03080 | VV0045 | 1670 | 2449 | FERRIC ENTEROBACTIN TRANSPORT ATP-BINDING PROTEIN FEPC |
| 393 | 394 | RXN03081 | VV0045 | 2476 | 2934 | FERRIENTEROBACTIN-BINDING PERIPLASMIC PROTEIN PRECURSOR |
| 395 | 396 | RXN03082 | VV0045 | 3131 | 3451 | FERRIENTEROBACTIN-BINDING PERIPLASMIC PROTEIN PRECURSOR |

Other transporters

| Nucleic Acid SEQ ID NO | Amino Acid SEQ ID NO | Identification Code | Contig. | NT Start | NT Stop | Function |
|---|---|---|---|---|---|---|
| 397 | 398 | RXA02261 | GR00654 | 30936 | 32291 | AMMONIUM TRANSPORT SYSTEM |
| 399 | 400 | RXA02020 | GR00613 | 1015 | 5 | AROMATIC AMINO ACID TRANSPORT PROTEIN AROP |
| 401 | 402 | RXA00281 | GR00043 | 4721 | 5404 | BACITRACIN TRANSPORT ATP-BINDING PROTEIN BCRA |
| 403 | 404 | RXN00570 | VV0147 | 855 | 4 | BENZOATE MEMBRANE TRANSPORT PROTEIN |
| 405 | 406 | F RXA00570 | GR00153 | 1 | 498 | BENZOATE MEMBRANE TRANSPORT PROTEIN |
| 407 | 408 | RXN00571 | VV0173 | 1298 | 42 | BENZOATE MEMBRANE TRANSPORT PROTEIN |
| 409 | 410 | F RXA00571 | GR00154 | 2 | 1186 | BENZOATE MEMBRANE TRANSPORT PROTEIN |
| 411 | 412 | RXA00962 | GR00268 | 2 | 667 | BENZOATE MEMBRANE TRANSPORT PROTEIN |
| 413 | 414 | RXA02811 | GR00792 | 177 | 560 | BENZOATE MEMBRANE TRANSPORT PROTEIN |
| 415 | 416 | RXA02115 | GR00635 | 2 | 1198 | BENZOATE MEMBRANE TRANSPORT PROTEIN |
| 417 | 418 | RXN00590 | VV0178 | 5043 | 6230 | BRANCHED CHAIN AMINO ACID TRANSPORT SYSTEM II CARRIER PROTEIN |
| 419 | 420 | F RXA00590 | GR00157 | 178 | 564 | BRANCHED CHAIN AMINO ACID TRANSPORT SYSTEM II CARRIER PROTEIN |
| 421 | 422 | F RXA01538 | GR00427 | 5040 | 5429 | BRANCHED CHAIN AMINO ACID TRANSPORT SYSTEM II CARRIER PROTEIN |
| 423 | 424 | RXA01727 | GR00489 | 1471 | 194 | BRANCHED-CHAIN AMINO ACID TRANSPORT SYSTEM CARRIER PROTEIN |
| 425 | 426 | RXA00623 | GR00163 | 6525 | 7862 | C4-DICARBOXYLATE TRANSPORT PROTEIN |
| 427 | 428 | RXA01584 | GR00441 | 55 | 597 | CHROMATE TRANSPORT PROTEIN |
| 429 | 430 | RXA00852 | GR00231 | 3137 | 2448 | COBALT TRANSPORT ATP-BINDING PROTEIN CBIO |
| 431 | 432 | RXA00690 | GR00181 | 1213 | 68 | COBALT TRANSPORT PROTEIN CBIQ |
| 433 | 434 | RXA00827 | GR00223 | 1319 | 567 | COBALT TRANSPORT PROTEIN CBIQ |
| 435 | 436 | RXA00851 | GR00231 | 2448 | 1840 | COBALT TRANSPORT PROTEIN CBIQ |
| 437 | 438 | RX503220 | GR00768 | 346 | 630 | D-XYLOSE-PROTON SYMPORT |
| 439 | 440 | F RXA02762 | VV0129 | 27509 | 26844 | D-XYLOSE PROTON-SYMPORTER |
| 441 | 442 | RXN00092 | GR00014 | 1 | 204 | GLUTAMINE TRANSPORT ATP-BINDING PROTEIN GLNQ |
| 443 | 444 | F RXA00092 | VV0030 | 6227 | 5376 | GLUTAMINE TRANSPORT ATP-BINDING PROTEIN GLNQ |
| 445 | 446 | RXN03060 | GR00745 | 1914 | 2351 | GLUTAMINE TRANSPORT ATP-BINDING PROTEIN GLNQ |
| 447 | 448 | F RXA02618 | GR10040 | 2979 | 2128 | GLUTAMINE TRANSPORT ATP-BINDING PROTEIN GLNQ |
| 449 | 450 | F RXA02900 | | | | GLUTAMINE TRANSPORT ATP-BINDING PROTEIN GLNQ |
| 451 | 452 | RX503212 | | | | GLYCINE BETAINE TRANSPORTER BETP |
| 453 | 454 | F RXA01591 | GR00446 | 3 | 947 | GLYCINE BETAINE TRANSPORTER BETP |
| 455 | 456 | RXN00201 | VV0096 | 197 | 6 | HIGH AFFINITY RIBOSE TRANSPORT PROTEIN RBSD |
| 457 | 458 | F RXA00201 | GR00032 | 191 | 6 | HIGH AFFINITY RIBOSE TRANSPORT PROTEIN RBSD |
| 459 | 460 | RXA01221 | GR00354 | 2108 | 2833 | HIGH-AFFINITY BRANCHED-CHAIN AMINO ACID TRANSPORT ATP-BINDING PROTEIN BRAG |

TABLE 1-continued

GENES IN THE APPLICATION

| Nucleic Acid SEQ ID NO | Amino Acid SEQ ID NO | Identification Code | Contig. | NT Start | NT Stop | Function |
|---|---|---|---|---|---|---|
| 461 | 462 | RXA01222 | GR00354 | 2844 | 3542 | HIGH-AFFINITY BRANCHED-CHAIN AMINO ACID TRANSPORT ATP-BINDING PROTEIN LIVF |
| 463 | 464 | RXA01219 | GR00354 | 151 | 1032 | HIGH-AFFINITY BRANCHED-CHAIN AMINO ACID TRANSPORT PERMEASE PROTEIN LIVH |
| 465 | 466 | RXA01220 | GR00354 | 1032 | 2108 | HIGH-AFFINITY BRANCHED-CHAIN AMINO ACID TRANSPORT PERMEASE PROTEIN LIVM |
| 467 | 468 | RXA00091 | GR00013 | 7762 | 8514 | IRON(III) DICITRATE TRANSPORT ATP-BINDING PROTEIN FECE |
| 469 | 470 | RXA00228 | GR00032 | 29232 | 28642 | IRON(III) DICITRATE TRANSPORT ATP-BINDING PROTEIN FECE |
| 471 | 472 | RXA00346 | GR00064 | 1054 | 1743 | IRON(III) DICITRATE TRANSPORT ATP-BINDING PROTEIN FECE |
| 473 | 474 | RXA00524 | GR00135 | 779 | 1111 | IRON(III) DICITRATE TRANSPORT ATP-BINDING PROTEIN FECE |
| 475 | 476 | RXA01823 | GR00516 | 591 | 1367 | IRON(III) DICITRATE TRANSPORT ATP-BINDING PROTEIN FECE |
| 477 | 478 | RXA02767 | GR00770 | 1032 | 1814 | IRON(III) DICITRATE TRANSPORT ATP-BINDING PROTEIN FECE |
| 479 | 480 | RXA02792 | GR00777 | 8581 | 7829 | IRON(III) DICITRATE TRANSPORT ATP-BINDING PROTEIN FECE |
| 481 | 482 | RXN02929 | VV0090 | 36837 | 37874 | IRON(III) DICITRATE TRANSPORT SYSTEM PERMEASE PROTEIN FECD |
| 483 | 484 | F RXA01235 | GR00358 | 1165 | 194 | IRON(III) DICITRATE TRANSPORT SYSTEM PERMEASE PROTEIN FECD |
| 485 | 486 | RXN02794 | VV0134 | 10625 | 9552 | IRON(III) DICITRATE TRANSPORT SYSTEM PERMEASE PROTEIN FECD |
| 487 | 488 | F RXA01419 | GR00415 | 888 | 1151 | IRON(III) DICITRATE TRANSPORT SYSTEM PERMEASE PROTEIN FECD |
| 489 | 490 | F RXA02794 | GR00777 | 10172 | 9552 | IRON(III) DICITRATE TRANSPORT SYSTEM PERMEASE PROTEIN FECD |
| 491 | 492 | RXN03079 | VV0045 | 644 | 1660 | IRON(III) DICITRATE TRANSPORT SYSTEM PERMEASE PROTEIN FECD |
| 493 | 494 | F RXA02865 | GR10007 | 3832 | 2816 | IRON(III) DICITRATE TRANSPORT SYSTEM PERMEASE PROTEIN FECD |
| 495 | 496 | RXA00181 | GR00028 | 3954 | 2383 | PROLINE TRANSPORT SYSTEM |
| 497 | 498 | RXA00591 | GR00158 | 229 | 1581 | PROLINE/BETAINE TRANSPORTER |
| 499 | 500 | RXA01629 | GR00453 | 3476 | 1965 | PROLINE/BETAINE TRANSPORTER |
| 501 | 502 | RXA02030 | GR00618 | 3072 | 1687 | PROLINE/BETAINE TRANSPORTER |
| 503 | 504 | RXA00186 | GR00028 | 12242 | 12988 | SHORT-CHAIN FATTY ACIDS TRANSPORTER |
| 505 | 506 | RXA00187 | GR00028 | 13097 | 13447 | SHORT-CHAIN FATTY ACIDS TRANSPORTER |
| 507 | 508 | RXA01667 | GR00464 | 703 | 1908 | SODIUM/GLUTAMATE SYMPORT CARRIER PROTEIN |
| 509 | 510 | RXA02171 | GR00641 | 6571 | 4919 | SODIUM/PROLINE SYMPORTER |
| 511 | 512 | RXA00902 | GR00245 | 4643 | 5875 | SODIUM-DEPENDENT PHOSPHATE TRANSPORT PROTEIN |
| 513 | 514 | RXA00941 | GR00257 | 1999 | 683 | sodium-dependent phosphate transport protein |
| 515 | 516 | RXN00298 | VV0112 | 30992 | 32572 | Sodium-Dicarboxylate Symport Protein |
| 517 | 518 | RXN00449 | GR00109 | 2040 | 1036 | Sodium-Dicarboxylate Symport Protein |
| 519 | 520 | F RXA00449 | GR00498 | 352 | 5 | Sodium-Dicarboxylate Symport Protein |
| 521 | 522 | RXA00269 | GR00041 | 1826 | 1038 | SPERMIDINE/PUTRESCINE TRANSPORT ATP-BINDING PROTEIN POTA |
| 523 | 524 | RXA00369 | GR00076 | 583 | 1299 | SPERMIDINE/PUTRESCINE TRANSPORT ATP-BINDING PROTEIN POTA |
| 525 | 526 | RXA02073 | GR00628 | 4176 | 2647 | TRANSPORT ATP-BINDING PROTEIN CYDC |
| 527 | 528 | RXA01399 | GR00409 | 1 | 1119 | TRANSPORT ATP-BINDING PROTEIN CYDD |
| 529 | 530 | RXA01339 | GR00389 | 8408 | 7164 | TYROSINE-SPECIFIC TRANSPORT PROTEIN |
| 531 | 532 | RXA02527 | GR00725 | 5519 | 6847 | 2-OXOGLUTARATE/MALATE TRANSLOCATOR PRECURSOR |
| 533 | 534 | RXN00298 | VV0176 | 40228 | 42072 | HIGH-AFFINITY CHOLINE TRANSPORT PROTEIN |
| 535 | 536 | F RXA00298 | GR00048 | 4459 | 6303 | Ectoine/Proline/Glycine betaine carrier ectP |
| 537 | 538 | RXA00596 | GR00159 | 335 | 787 | potassium efflux system protein phaE |
| 539 | 540 | RXA02364 | GR00686 | 841 | 215 | C4-DICARBOXYLATE-BINDING PERIPLASMIC PROTEIN PRECURSOR, transport protein |
| 541 | 542 | RXN01411 | VV0050 | 26015 | 26779 | SHIKIMATE TRANSPORTER |
| 543 | 544 | RXN00960 | VV0075 | 1139 | 105 | PROTON/SODIUM-GLUTAMATE SYMPORT PROTEIN |
| 545 | 546 | RXN02447 | VV0107 | 14297 | 13203 | GALACTOSE-PROTON SYMPORT |

TABLE 1-continued

GENES IN THE APPLICATION

| Nucleic Acid SEQ ID NO | Amino Acid SEQ ID NO | Identification Code | Contig. | NT Start | NT Stop | Function |
|---|---|---|---|---|---|---|
| 547 | 548 | RXN02395 | VV0176 | 16747 | 14858 | GLYCINE BETAINE TRANSPORTER BETP |
| 549 | 550 | RXN02348 | VV0078 | 6027 | 7910 | KUP SYSTEM POTASSIUM UPTAKE PROTEIN |
| 551 | 552 | RXN00297 | VV0176 | 38630 | 39541 | Hypothetical Malonate Transporter |
| 553 | 554 | RXN03103 | VV0070 | 845 | 1087 | GLUTAMATE-BINDING PROTEIN PRECURSOR |
| 555 | 556 | RXN02993 | VV0071 | 736 | 65 | GLUTAMINE-BINDING PROTEIN |
| 557 | 558 | RXN00349 | VV0135 | 35187 | 36653 | Hypothetical Trehalose Transport Protein |
| 559 | 560 | RXN03095 | VV0057 | 4056 | 4424 | CADMIUM EFFLUX SYSTEM ACCESSORY PROTEIN HOMOLOG |
| 561 | 562 | RXN03160 | VV0189 | 5150 | 5617 | CHROMATE TRANSPORT PROTEIN |
| 563 | 564 | RXN02955 | VV0176 | 8666 | 9187 | DICARBOXYLATE TRANSPORTER |
| 565 | 566 | RXN03109 | VV0082 | 659 | 6 | HEMIN TRANSPORT SYSTEM PERMEASE PROTEIN HMUU |
| 567 | 568 | RXN02979 | VV0149 | 2150 | 2383 | MERCURIC TRANSPORT PROTEIN PERIPLASMIC COMPONENT PRECURSOR |
| 569 | 570 | RXN02987 | VV0234 | 527 | 294 | MERCURIC TRANSPORT PROTEIN PERIPLASMIC COMPONENT PRECURSOR |
| 571 | 572 | RXN03084 | VV0048 | 900 | 1817 | IRON(III) DICITRATE-BINDING PERIPLASMIC PROTEIN PRECURSOR |
| 573 | 574 | RXN03183 | VV0372 | 1 | 417 | TREHALOSE/MALTOSE BINDING PROTEIN |
| 575 | 576 | RXN01139 | VV0077 | 2776 | 1823 | CATION EFFLUX SYSTEM PROTEIN CZCD |
| 577 | 578 | RXN00378 | VV0223 | 8027 | 5418 | Cation transport ATPases |
| 579 | 580 | RXN01338 | VV0032 | 2 | 1903 | CATION-TRANSPORTING ATPASE PACS (EC 3.6.1.—) |
| 581 | 582 | RXN00980 | VV0149 | 2635 | 4428 | CATION-TRANSPORTING P-TYPE ATPASE B (EC 3.6.1.—) |
| 583 | 584 | RXN00099 | VV0129 | 18876 | 17704 | CYANATE TRANSPORT PROTEIN CYNX |
| 585 | 586 | RXN02662 | VV0315 | 1461 | 1724 | DIPEPTIDE TRANSPORT SYSTEM PERMEASE PROTEIN DPPC |
| 587 | 588 | RXN02442 | VV0217 | 5970 | 6818 | zinc transport system membrane protein |
| 589 | 590 | RXN02443 | VV0217 | 6818 | 7771 | zinc-binding periplasmic protein precursor |
| 591 | 592 | RXN00842 | VV0138 | 8686 | 7487 | BRANCHED CHAIN AMINO ACID TRANSPORT SYSTEM II CARRIER PROTEIN |
| 593 | 594 | F RXA00842 | GR00228 | 3208 | 2009 | Permeases |
| 595 | 596 | RXN00832 | VV0180 | 3133 | 4182 | CALCIUM/PROTON ANTIPORTER |
| 597 | 598 | RXN00466 | VV0086 | 63271 | 64266 | Ferrichrome transport proteins |
| 599 | 600 | RXN01936 | VV0127 | 40116 | 41387 | MACROLIDE-EFFLUX PROTEIN |
| 601 | 602 | RXN01995 | VV0182 | 2139 | 3476 | PUTATIVE 3-(3-HYDROXYPHENYL) PROPIONATE TRANSPORT PROTEIN |
| 603 | 604 | RXN00661 | VV0142 | 9718 | 9029 | PNUC PROTEIN |

Permeases

| Nucleic Acid SEQ ID NO | Amino Acid SEQ ID NO | Identification Code | Contig. | NT Start | NT Stop | Function |
|---|---|---|---|---|---|---|
| 605 | 606 | RXN02566 | VV0154 | 11823 | 13031 | NUCLEOSIDE PERMEASE NUPG |
| 607 | 608 | F RXA02561 | GR00732 | 664 | 5 | NUCLEOSIDE PERMEASE NUPG |
| 609 | 610 | F RXA02566 | GR00733 | 782 | 345 | NUCLEOSIDE PERMEASE NUPG |
| 611 | 612 | RXA00051 | GR00008 | 5770 | 7173 | PROLINE-SPECIFIC PERMEASE PROY |
| 613 | 614 | RXA01172 | GR00334 | 2687 | 4141 | SULFATE PERMEASE |
| 615 | 616 | RXA02128 | GR00637 | 2906 | 4600 | SULFATE PERMEASE |
| 617 | 618 | RXA02634 | GR00748 | 6045 | 7655 | SULFATE PERMEASE |
| 619 | 620 | RXN02233 | VV0068 | 6856 | 8142 | URACIL PERMEASE |
| 621 | 622 | F RXA02233 | GR00653 | 6856 | 8067 | URACIL PERMEASE |
| 623 | 624 | RXN02372 | VV0213 | 9311 | 11197 | XANTHINE PERMEASE |
| 625 | 626 | F RXA02372 | GR00688 | 6 | 560 | XANTHINE PERMEASE |
| 627 | 628 | F RXA02377 | GR00689 | 3336 | 4526 | XANTHINE PERMEASE |
| 629 | 630 | RXA02676 | GR00754 | 2697 | 1309 | GLUCONATE PERMEASE |
| 631 | 632 | RXN00432 | VV0112 | 14751 | 13267 | NA(+)-LINKED D-ALANINE GLYCINE PERMEASE |
| 633 | 634 | F RXA00432 | GR00100 | 1 | 891 | NA(+)-LINKED D-ALANINE GLYCINE PERMEASE |
| 635 | 636 | F RXA00436 | GR00101 | 45 | 569 | NA(+)-LINKED D-ALANINE GLYCINE PERMEASE |

TABLE 1-continued

GENES IN THE APPLICATION

| Nucleic Acid SEQ ID NO | Amino Acid SEQ ID NO | Identification Code | Contig. | NT Start | NT Stop | Function |
|---|---|---|---|---|---|---|
| 637 | 638 | RXA00847 | GR00230 | 1829 | 381 | OLIGOPEPTIDE-BINDING PROTEIN APPA PRECURSOR (permease) |
| 639 | 640 | RXN01382 | VV0119 | 8670 | 9761 | OLIGOPEPTIDE-BINDING PROTEIN OPPA PRECURSOR |
| 641 | 642 | F RXA01382 | GR00405 | 1067 | 6 | OLIGOPEPTIDE-BINDING PROTEIN OPPA PRECURSOR (permease) |
| 643 | 644 | RXA02659 | GR00753 | 2 | 313 | OLIGOPEPTIDE-BINDING PROTEIN OPPA PRECURSOR (permease) |
| 645 | 646 | RXN02933 | VV0176 | 30042 | 29233 | DIPEPTIDE TRANSPORT SYSTEM PERMEASE PROTEIN DPPC |
| 647 | 648 | RXN02991 | VV0072 | 618 | 4 | GLUTAMINE TRANSPORT SYSTEM PERMEASE PROTEIN GLNP |
| 649 | 650 | RXN02992 | VV0072 | 842 | 621 | GLUTAMINE TRANSPORT SYSTEM PERMEASE PROTEIN GLNP |
| 651 | 652 | RXN02996 | VV0069 | 1980 | 2648 | HIGH-AFFINITY BRANCHED-CHAIN AMINO ACID TRANSPORT PERMEASE PROTEIN LIVH |
| 653 | 654 | RXA03126 | VV0112 | 9894 | 9001 | TEICHOIC ACID TRANSLOCATION PERMEASE PROTEIN TAGG |
| 655 | 656 | RXN00443 | VV0112 | 21572 | 20769 | MOLYBDATE-BINDING PERIPLASMIC PROTEIN PRECURSOR |
| 657 | 658 | RXN00444 | VV0112 | 20785 | 19949 | MOLYBDENUM TRANSPORT SYSTEM PERMEASE PROTEIN MODB |
| 659 | 660 | RXN00193 | VV0371 | 1 | 594 | POTENTIAL STARCH DEGRADATION PRODUCTS TRANSPORT SYSTEM PERMEASE PROTEIN AMYD |
| 661 | 662 | RXN01298 | VV0116 | 2071 | 1142 | POTENTIAL STARCH DEGRADATION PRODUCTS TRANSPORT SYSTEM PERMEASE PROTEIN AMYD |

Channel Proteins

| | | | | | | |
|---|---|---|---|---|---|---|
| 663 | 664 | RXA01737 | GR00493 | 2913 | 3971 | POTASSIUM CHANNEL PROTEIN |
| 665 | 666 | RXN02348 | VV0078 | 6027 | 7910 | KUP SYSTEM POTASSIUM UPTAKE PROTEIN |
| 667 | 668 | RXA02426 | GR00707 | 2165 | 633 | PROBABLE NA(+)/H(+) ANTIPORTER |
| 669 | 670 | RXN03164 | VV0277 | 1586 | 2455 | POTASSIUM CHANNEL BETA SUBUNIT |
| 671 | 672 | RXN00024 | VV0127 | 64219 | 63275 | POTASSIUM CHANNEL BETA SUBUNIT |

Lipoprotein and Lipopolysaccharide synthesis

| | | | | | | |
|---|---|---|---|---|---|---|
| 673 | 674 | RXN01164 | VV0117 | 15894 | 14260 | DOLICHOL-PHOSPHATE MANNOSYLTRANSFERASE (EC 2.4.1.83)/ APOLIPOPROTEIN N-ACYLTRANSFERASE (EC 2.3.1.—) |
| 675 | 676 | RXN01168 | VV0117 | 14224 | 13415 | DOLICHOL-PHOSPHATE MANNOSYLTRANSFERASE (EC 2.4.1.83)/ APOLIPOPROTEIN N-ACYLTRANSFERASE (EC 2.3.1.—) |

TABLE 2

GENES IDENTIFIED FROM GENBANK

| GenBank ® Accession No. | Gene Name | Gene Function | Reference |
|---|---|---|---|
| A09073 | ppg | Phosphoenol pyruvate carboxylase | Bachmann, B. et al. "DNA fragment coding for phosphoenolpyruvat corboxylase, recombinant DNA carrying said fragment, strains carrying the recombinant DNA and method for producing L-aminino acids using said strains," Patent: EP 0358940-A 3 Mar. 21, 1990 |
| A45579, A45581, A45583, A45585, A45587 | | Threonine dehydratase | Moeckel, B. et al. "Production of L-isoleucine by means of recombinant micro-organisms with deregulated threonine dehydratase," Patent: WO 9519442-A 5 July 20, 1995 |
| AB003132 | murC; ftsQ; ftsZ | | Kobayashi, M. et al. "Cloning, sequencing, and characterization of the ftsZ gene from coryneform bacteria," Biodzem. Biophys. Res. Commun., 236(2):383–388 (1997) |
| AB015023 | murC; ftsQ | | Wachi, M. et al. "A murC gene from Coryneform bacteria," Appl. Microbiol. Biotechnol. 51(2):223–228 (1999) |
| AB018530 | dtsR | | Kimura, E. et al. "Molecular cloning of a novel gene, dtsR, which rescues the detergent sensitivity of a mutant derived from Brevibacterium lactoferinentum," Biosci. Biotechnol. Biochem., 60(10):1565–1570 (1996) |
| AB018531 | dtsR1; dtsR2 | | |
| AB020624 | murI | D-glutamate racemase | |
| AB023377 | tkt | transketolase | |
| AB024708 | gltB; gltD | Glutamine 2-oxoglutarate aminotransferase large and small subunits | |
| AB025424 | acn | aconitase | |
| AB027714 | rep | Replication protein | |
| AB027715 | rep; aad | Replication protein; aminoglycoside adenyltransferase | |
| AF005242 | argC | N-acetyl glutamate-5-semialdehyde dehydrogenase | |
| AF005635 | glnA | Glutamine synthetase | |
| AF030405 | hisF | cyclase | |
| AF030520 | argG | Argininosuccinate synthetase | |
| AF631518 | argF | Ornithine carbamolytransferase | |
| AF036932 | aroD | 3-dehydroquinate dehydratase | |
| AF038548 | pyc | Pyruvate carboxylase | |
| AF038651 | dciAE; apt; rel | Dipeptide-binding protein; adenine phosphoribosyltransferase; GTP pyrophosphokinase | Wehmeier, L. et al. "The role of the Corynebacterium glutamicum rel gene in (p)ppGpp metabolism," Microbiology, 144:1853–1862 (1998) |
| AF041436 | argR | Arginine repressor | |
| AF045998 | impA | Inositol monophosphate phosphatase | |
| AF048764 | argH | Argininosuccinate lyase | |

TABLE 2-continued

GENES IDENTIFIED FROM GENBANK

| GenBank ® Accession No. | Gene Name | Gene Function | Reference |
|---|---|---|---|
| AF049897 | argC; argJ; argB; argD; argF; argR; argG; argH | N-acetylglutamylphosphate reductase; ornithine acetyltransferase; N-acetylglutamate kinase; acetylornithine transminase; ornithine carbamoyltransferase; arginine repressor; argininosuccinate synthase; argininosuccinate lyase | |
| AF050109 | inhA | Enoyl-acyl carrier protein reductase | |
| AF050166 | hisG | ATP phosphoribosyltransferase | |
| AF051846 | hisA | Phosphoribosylformimino-5-amino-1-phosphoribosyl-4-imidazolecarboxamide isomerase | |
| AF052652 | metA | Homoserine O-acetyltransferase | Park, S. et al. "Isolation and analysis of metA, a methionine biosynthetic gene encoding homoserine acetyltransferase in *Corynebacterium glutamicum*," Mol. Cells, 8(3):286–294 (1998) |
| AF053071 | aroB | Dehydroquinate synthetase | |
| AF060558 | hisH | Glutamine amidotransferase | |
| AF086704 | hisE | Phosphoribosyl-ATP-pyrophosphohydrolase | |
| AF114233 | aroA | 5-enolpyruvylshikimate 3-phosphate synthase | |
| AF116184 | panD | L-aspartate-alpha-decarboxylase precursor | Dusch, N. et al. "Expression of the *Corynebacterium glutamicum* panD gene encoding L-aspartate-alpha-decarboxylase leads to pantothenate overproduction in *Escherichia coli*," Appl. Environ. Microbiol., 65(4)1530–1539 (1999) |
| AF124518 | aroD; aroE | 3-dehydroquinase; shikimate dehydrogenase | |
| AF124600 | aroC; aroK; aroB; pepQ | Chorismate synthase; shikimate kinase; 3-dehydroquinate synthase; putative cytoplasmic peptidase | |
| AF145897 | inhA | | |
| AF145898 | inhA | | |
| AJ001436 | ectP | Transport of ectoine, glycine betaine, proline | Peter, H. et al. "*Corynebacterium glutamicum* is equipped with four secondary carriers for compatible solutes: Identification, sequencing, and characterization of the proline/ectoine uptake system, ProP, and the ectoine/proline/glycine betaine carrier, EctP," J. Bacteriol, 180(22):6005–6012 (1998) Wehrmann, A. et al. "Different modes of diaminopimelate synthesis and their role in cell wall integrity: A study with *Corynebacterium glutamicum*," J. Bacteriol., 180(12):3159–3165 (1998) |
| AJ004934 | dapD | Tetrahydrodipicolinate succinylase (incomplete) | |
| AJ007732 | ppc; secG; amt; ocd; soxA | Phosphoenolpyruvate-carboxylase; ?; high affinity ammonium uptake protein; putative ornithine-cyclodecarboxylase; sarcosine oxidase | |
| AJ010319 | ftsY, glnB, glnD; srp; amtP | Involved in cell division; PII protein; uridylyltransferase (uridylyl-removing enzmye); signal recognition particle; low affinity ammonium uptake protein | Jakoby, M. et al. "Nitrogen regulation in *Corynebacterium glutamicum*; Isolation of genes involved in biochemical characterization of corresponding proteins," FEMS Microbiol., 173(2):303–310 (1999) |

TABLE 2-continued

GENES IDENTIFIED FROM GENBANK

| GenBank® Accession No. | Gene Name | Gene Function | Reference |
|---|---|---|---|
| AJ132968 | cat | Chloramphenicol acetyl transferase | |
| AJ224946 | mqo | L-malate: quinone oxidoreductase | Molenaar, D. et al. "Biochemical and genetic characterization of the membrane-associated malate dehydrogenase (acceptor) from *Corynebacterium glutamicum*," Eur. J. Biochem., 254(2):395–403 (1998) |
| AJ238250 | ndh | NADH dehydrogenase | |
| AJ238703 | porA | Porin | Lichtinger, T. et al. "Biochemical and biophysical characterization of the cell wall porin of *Corynebacterium glutamicum*: The channel is formed by a low molecular mass polypeptide," Biochemistry, 37(43):15024–15032 (1998) |
| D17429 | | Transposable element I31831 | Vertes, A.A. et al. "Isolation and characterization of IS31831, a transposable element from *Corynebacterium glutamicum*," Mol. Microbiol., 11(4):739–746 (1994) |
| D84102 | odhA | 2-oxoglutarate dehydrogenase | Usuda, Y. et al. "Molecular cloning of the *Corynebacterium glutamicum* (*Brevibacterium lactofermentum* AJ12036) odhA gene encoding a novel type of 2-oxoglutarate dehydrogenase," Microbiology, 142:3347–3354 (1996) |
| E01358 | hdh; hk | Homoserine dehydrogenase; homoserine kinase | Katsumata, R. et al. "Production of L-threonine and L-isoleucine," Patent: JP 1987232392-A 1 Oct. 12, 1987 |
| E01359 | | Upstream of the start codon of homoserine kinase gene | Katsumata, R. et al. "Production of L-threonine and L-isoleucine," Patent: JP 1987232392-A 2 Oct. 12, 1987 |
| E01375 | | Tryptophan operon | |
| E01376 | trpL; trpE | Leader peptide; anthranilate synthase | Matsui, K. et al. "Tryptophan operon, peptide and protein coded thereby, utilization of tryptophan operon gene expression and production of tryptophan," Patent: JP 1987244382-A 1 Oct. 24, 1987 |
| E01377 | | Promoter and operator regions of tryptophan operon | Matsui, K. et al. "Tryptophan operon, peptide and protein coded thereby, utilization of tryptophan operon gene expression and production of tryptophan," Patent: JP 1987244382-A 1 Oct. 24, 1987 |
| L03937 | | Biotin-synthase | Hatakeyama. K. et al. "DNA fragment containing gene capable of coding biotin synthetase and its utilization," Patent: JP 1992278088-A 1 Oct. 2, 1992 |
| L04040 | | Diamino pelargonic acid aminotransferase | Kohama, K. et al. "Gene coding diaminopelargonic acid aminotransferase and desthiobiotin synthetase and its utilization," Patent: JP 1992330284-A 1 Nov. 18, 1992 |
| L04041 | | Desthiobiotinsynthetase | Kohama, K. et al. "Gene coding diaminopelargonic acid aminotransferase and desthiobiotin synthetase and its utilization," Patent: JP 1992330284-A 1 Nov. 18, 1992 |
| E04307 | | Flavum aspartase | Kurusu, Y. et al. "Gene DNA coding aspartase and utilization thereof," Patent: JP 1993030977-A 1 Feb. 9, 1993 |
| E04376 | | Isocitric acid lyase | Katsumata, R. et al. "Gene manifestation controlling DNA," Patent: JP 1993056782-A 3 Mar. 9, 1993 |
| E04377 | | Isocitric acid lyase N-terminal fragment | Katsumata, R. et al. "Gene manifestation controlling DNA," Patent: JP 1993056782-A 3 Mar. 9, 1993 |
| E04484 | | Prephenate dehydratase | Sotouchi, N. et al. "Production of L-phenylalanine by fermentation," Patent: JP 1993076352-A 2 Mar. 30, 1993 |
| L05108 | | Aspartokinase | Fugono, N. et al. "Gene DNA coding Aspartokinase and its use," Patent: JP 1993184366-A 1 July 27, 1993 |
| E05112 | | Dihydro-dipichorinate synthetase | Hatakeyama, K. et al. "Gene DNA coding dihydrodipicolinic acid synthetase and its use," Patent: JP 1993184371-A 1 July 27, 1993 |
| L05776 | | Diaminopimelic acid dehydrogenase | Kobayashi, M. et al. "Gene DNA coding Diaminopimelic acid dehydrogenase and its use," Patent: JP 1993284970-A 1 Nov. 2, 1993 |

TABLE 2-continued

GENES IDENTIFIED FROM GENBANK

| GenBank® Accession No. | Gene Name | Gene Function | Reference |
|---|---|---|---|
| E05779 | | Threonine synthase | Kohama, K. et al. "Gene DNA coding threonine synthase and its use," Patent: JP 1993284972-A 1 Nov. 2, 1993 |
| E06110 | | Prephenate dehydratase | Kikuchi, T. et al. "Production of L-phenylalanine by fermentation method," Patent: JP 1993344881-A 1 Dec. 27, 1993 |
| E06111 | | Mutated Prephenate dehydratase | Kikuchi, T. et al. "Production of L-phenylalanine by fermentation method," Patent: JP 1993344881-A 1 Dec. 27, 1993 |
| E06146 | | Acetohydroxy acid synthetase | Inui, M. et al. "Gene capable of coding Acetohydroxy acid synthetase and its use," Patent: JP 1993344893-A 1 Dec. 27, 1993 |
| E06825 | | Aspartokinase | Sugimoto, M. et al. "Mutant aspartokinase gene," patent: JP 199406286-A 1 Mar. 08, 1994 |
| E06826 | | Mutated aspartokinase alpha subunit | Sugimoto, M. et al. "Mutant aspartokinase gene," patent: JP 199406286-A 1 Mar. 8, 1994 |
| E06827 | | Mutated aspartokinase alpha subunit | Sugimoto, M. et al. "Mutant aspartokinase gene," patent: JP 199406286-A 1 Mar. 8, 1994 |
| E07701 | secY | | Honno, N. et al. "Gene DNA participating in integration of membraneous protein to membrane," Patent: JP 1994169780-A 1 June 21, 1994 |
| E08177 | | Aspartokinase | Sato, Y. et al. "Genetic DNA capable of coding Aspartokinase released from feedback inhibition and its utilization," Patent: JP 1994261766-A 1 Sept. 20, 1994 |
| E08178, E08179, E08180, E08181, E08182 | | Feedback inhibition-released Aspartokinase | Sato, Y. et al. "Genetic DNA capable of coding Aspartokinase released from feedback inhibition and its utilization," Patent: JP 1994261766-A 1 Sept. 20, 1994 |
| L08232 | | Acetohydroxy-acid isomeroreductase | Inui, M. et al. "Gene DNA coding acetohydroxy acid isomeroreductase," Patent: JP 1994277067-A 1 Oct. 4, 1994 |
| E08234 | secE | | Asai, Y. et al. "Gene DNA coding for translocation machinery of protein," Patent: JP 1994277073-A 1 Oct. 4, 1994 |
| F08643 | | FT aminotransferase and desthiobiotin synthetase promoter region | Hatakeyama, K. et al. "DNA fragment having promoter function in coryneform bacterium," Patent: JP 1995031476-A 1 Feb. 3, 1995 |
| E08646 | | Biotin synthetase | Hatakeyama, K. et al. "DNA fragment having promoter function in coryneform bacterium," Patent: JP 1995031476-A 1 Feb. 3, 1995 |
| E08049 | | Aspartase | Kohama, K. et al "DNA fragment having promoter function in coryneform bacterium," Patent: JP 1995031478-A 1 Feb. 3, 1995 |
| E08900 | | Dihydrodipicolinate reductase | Madori, M. et al. "DNA fragment containing gene coding Dihydrodipicolinate acid reductase and utilization thereof," Patent: JP 1995075578-A 1 Mar. 20, 1995 |
| E08901 | | Diaminopimelic acid decarboxylase | Madori, M. et al. "DNA fragment containing gene coding Diaminopimelic acid decarboxylase and utilization thereof," Patent: JP 1995075579-A 1 Mar. 20, 1995 |
| E12594 | | Serine hydroxymethyltransferase | Hatakeyama, K. et al. "Production of L-trypophan," Patent: JP 1997028391-A 1 Feb. 4, 1997 |
| E12760, E12759, E12758 | | transposase | Moriya, M. et al. "Amplification of gene using artificial transposon," Patent: JP 1997070291-A Mar. 18, 1997 |
| E12764 | | Arginyl-tRNA synthetase; diaminopimelic acid decarboxylase | Moriya, M. et al. "Amplification of gene using artificial transposon," Patent: JP 1997070291-A Mar. 18, 1997 |
| E12767 | | Dihydrodipicolinic acid synthetase | Moriya, M. et al. "Amplification of gene using artificial transposon," Patent: JP 1997070291-A Mar. 18, 1997 |

TABLE 2-continued

GENES IDENTIFIED FROM GENBANK

| GenBank ® Accession No. | Gene Name | Gene Function | Reference |
|---|---|---|---|
| E12770 | | aspartokinase | Moriya, M. et al. "Amplification of gene using artificial transposon," Patent: JP 1997070291-A Mar. 18, 1997 |
| E12773 | | Dihydrodipicolinic acid reductase | Moriya, M. et al. "Amplification of gene using artificial transposon," Patent: JP 1997070291-A Mar. 18, 1997 |
| E13655 | | Glucose-6-phosphate dehydrogenase | Hatakeyama, K. et al. "Glucose-6-phosphate dehydrogenase and DNA capable of coding the same," Patent: JP 1997224661-A 1 Sept. 2, 1997 |
| L01508 | IlvA | Threonine dehydratase | Moeckel, B. et al. "Functional and structural analysis of the threonine dehydratase of Corynebacterium glutamicum "J Bacteriol., 174:8065–8072 (1992) |
| L07603 | EC 4.2.1.15 | 3-deoxy-D-arabinoheptulosonate-7-phosphate synthase | Chen, C. et al. "The cloning and nucleotide sequence of Corynebacterium glutamicum 3-deoxy-D-arabinoheptulosonate-7-phosphate synthase gene," FEMS Microbiol. Lett., 107:223–230 (1993) |
| L09232 | IlvB; ilvN; ilvC | Acetohydroxy acid synthase large subunit; Acetohydroxy acid synthase small subunit; Acetohydroxy acid isomeroreductase | Keilhauer, C. et al. "Isoleucine synthesis in Corynebacterium glutamicum: molecular analysis of the ilvB-ilvN-ilvC operon," J. Bacteriol., 175(17):5595–5603 (1993) |
| L18874 | PtsM | Phosphoenolpyruvate sugar phosphotransferase | Fouet, A et al. "Bacillus subtilis sucrose-specific enzyme II of the phosphotransferase system: expression in Escherichia coli and homology to enzymes II from enteric bacteria," PNAS USA, 84(24):8773–8777 (1987); Lee, J.K. et al. "Nucleotide sequence of the gene encoding the Corynebacterium glutamicum mannose enzyme II and analyses of the deduced protein sequence," FEMS Microbiol. Lett., 119(1–2):137–145 (1994) |
| L27123 | aceB | Malate synthase | Lee, H-S. et al. "Molecular characterization of aceB, a gene encoding malate synthase in Corynebacterium glutamicum," J. Microbiol. Biotechnol., 4(4):256–263 (1994) |
| L27126 | | Pyruvate kinase | Jetten, M. S. et al. "Structural and functional analysis of pyruvate kinase from Corynebacterium glutamicum," Appl. Environ. Microbiol., 60(7):2501–2507 (1994) |
| L28760 | aceA | Isocitrate lyase | |
| L35906 | dtxr | Diphtheria toxin repressor | Oguiza, J.A. et al. "Molecular cloning, DNA sequence analysis, and characterization of the Corynebacterium diphtheriae dtxR from Brevibacterium lactofermentum," J. Bacteriol., 177(2):465–467 (1995) |
| M13774 | | Prephenate dehydratase | Follettie, M.T. et al. "Molecular cloning and nucleotide sequence of the Corynebacterium glutamicum pheA gene," J. Bacteriol., 167:695–702 (1986) |
| M16175 | 5S rRNA | | Park, Y-H. et al. "Phylogenetic analysis of the coryneform bacteria by 5S rRNA sequences," J. Bacteriol., 169:1801–1806 (1987) |
| M16663 | trpE | Anthranilate synthase, 5' end | Sano, K. et al. "Structure and function of the trp operon control regions of Brevibacterium lactofermentum, a glutamic-acid-producing bacterium," Gene, 52:191–200 (1987) |
| M16664 | trpA | Tryptophan synthase, 3'end | Sano, K. et al. "Structure and function of the trp operon control regions of Brevibacterium lactofermentum, a glutamic-acid-producing bacterium," Gene, 52:191–200 (1987) |
| M25819 | | Phosphoenolpyruvate carboxylase | O'Regan, M. et al. "Cloning and nucleotide sequence of the Phosphoenolpyruvate carboxylase-coding gene of Corynebacterium glutamicum AITCC13032," Gene, 77(2):237–251 (1989) |
| M85106 | | 23S rRNA gene insertion sequence | Roller, C. et al. "Gram-positive bacteria with a high DNA G + C content are characterized by a common insertion within their 23S rRNA genes," J. Gen. Microbiol., 138:1167–1175 (1992) |

TABLE 2-continued

GENES IDENTIFIED FROM GENBANK

| GenBank® Accession No. | Gene Name | Gene Function | Reference |
|---|---|---|---|
| M85107, M85108 | | 23S rRNA gene insertion sequence | Roller, C. et al. "Gram-positive bacteria with a high DNA G + C content are characterized by a common insertion within their 23S rRNA genes," J. Gen. Microbiol., 138:1167–1175 (1992) |
| M89931 | aecD; brnQ; yhbw | Beta C-S lyase; branched-chain amino acid uptake carrier; hypothetical protein yhbw | Rossol, I. et al. "The *Corynebacterium glutamicum* aecD gene encodes a C-S lyase with alpha, beta-elimination activity that degrades aminoethylcystein," J. Bacteriol., 174(9):2968–2977 (1992); Tauch, A. et al. "Isoleucine uptake in *Corynebacterium glutamicum* ATCC 13032 is directed by the brnQ gene product," Arch. Microbial., 169(4):303:312 (1998) |
| S59299 | trp | Leader gene (promoter) | Herry, D.M. et al. "Cloning of the trp gene cluster from a tryptophan-hyperproducing strain of *Corynebacterium glutamicum* ; identification of a mutation in the trp leader sequence," Appl, Environ. Microbiol., 59(3):791–799 (1993) |
| U11545 | trpD | Anthranilate phosphoribosyltransferase | O'Gara, J.P. and Dunican, L.K.(1994) Complete nucleotide sequence of the *Corynebacterium glutamicum* ATCC 21850 tpD gene." Thesis, Microbiology Department, University College Galway, Ireland. |
| U13922 | cgIIM; cgIIR; cIgIIR | Putative type II 5-cytosoine methyltransferase; putative type II restriction endonuclease; putative type I or type III restriction endonuclease | Schafer, A. et al. "Cloning and characterization of a DNA region encoding a stress-sensitive restriction system from *Corynebacterium glutamicum* ATCC 13032 and analysis of its role in intergeneric conjugation with *Escherichia coli*," J. Bacteriol., 176(23); 7309–7319 (1994); Schafer, A. et al. "The *Corynebacterium glutamicum* cgIIM gene encoding a 5-cytosine in an McrBC-dificient *Escherichia coli* strain," Gene, 203(2):95–101 (1997) |
| U14965 | recA | | |
| U31224 | ppx | | Ankri, S. et al. "Mutations in the *Corynebacterium glutamicum*proline biosynthetic pathway: A natural bypass of the proA step," J. Bacteriol., 178(15):4412–4419 (1996) |
| U31225 | proC | L-proline: NADP+ 5-oxidoreductase | Ankri, S. et al. "Mutations in the *Corynebacterium glutamicum*proline biosynthetic pathway: A natural bypass of the proA step," J. Bacteriol., 178(15):4412–4419 (1996) |
| U31230 | obg; proB; unkdh | ?;gamma glutamyl kinase;similar to D-isomer specific 2-hydroxyacid dehydrogenases | Ankri, S. et al. "Mutations in the *Corynebacterium glutamicum*proline biosynthetic pathway: A natural bypass of the proA step," J. Bacteriol., 178(15):4412–4419 (1996) |
| U31281 | bioB | Biotin synthase | Serebriiskii, I.G., "Two new members of the bio B superfamily: Cloning, sequencing and expression of bio B genes of *Methylobacillus flagellatum* and *Corynebacterium glutamicum*," Gene, 175:15–22 (1996) |
| U35023 | thtR; accBC | Thiosulfate sulfurtransferase; acyl CoA carboxylase | Jager, W. et al. "A *Corynebacterium glutamicum* gene encoding a two-domain protein similar to biotin carboxylases and biotin-carboxyl-carrier proteins," Arch. Microbiol., 166(2);76–82 (1996) |
| U43535 | cmr | Multidrug resistance protein | Jager, W. et al. "A *Corynebacterium glutamicum* gene conferring multidrug resistance in the heterologous host *Escherichia coli*," J. Bacteriol., 179(7):2449–2451 (1997) |
| U43536 | clpB | Heat shock ATP-binding protein | |
| U53587 | aphA-3 | 3'5"-aminoglycoside phosphotransferase | |
| U89648 | | *Corynebacterium glutamicum* unidentified sequence involved in histidine biosynthesis, partial sequence | |

TABLE 2-continued

GENES IDENTIFIED FROM GENBANK

| GenBank® Accession No. | Gene Name | Gene Function | Reference |
|---|---|---|---|
| X04900 | trpA; trpB; trpC; trpD; trpE; trpG; trpL | Tryptophan operon | Matsui, K. et al. "Complete nucleotide and deduced amino acid sequences of the Brevibacterium lactofermentum tryptophan operon," Nucleic Acids Res., 14(24):10113–10114 (1986) |
| X07563 | lys A | DAP decarboxylase (meso-diaminopimelate decarboxylase, EC 4.1.1.20) | Yeh, P. et al. "Nucleic sequence of the lysA gene of Corynebacterium glutamicum and possible mechanisms for modulation of its expression," Mol. Gen. Genet., 212(1):112–119 (1988) |
| X14234 | EC 4.1.1.31 | Phosphoenolpyruvate carboxylase | Eikmanns, B.J. et al. "The Phosphoenolpyruvate carboxylase gene of Corynebacterium glutamicum: Molecular cloning, nucleotide sequence, and expression," Mol. Gen. Genet., 218(2):330–339 (1989); Lepiniec, L. et al. "Sorghum Phosphoenolpyruvate carboxylase gene family: structure, function and molecular evolution," Plant. Mol. Biol., 21 (3):487–502 (1993) |
| X17313 | fda | Fructose-bisphosphate aldolase | Von der Osten, C.H. et al. "Molecular cloning, nucleotide sequence and fine-structural analysis of the Corynebacterium glutamicum fda gene: structural comparison of C. glutamicum fructose-1, 6-biphosphate aldolase to class I and class II aldolases," Mol. Microbiol., |
| X53993 | dapA | L-2, 3-dihydrodipicolinate synthetase (EC 4.2.1.52) | Bonnassie, S. et al. "Nucleic sequence of the dapA gene from Corynebacterium glutamicum," Nucleic Acids Res, 18(21):6421 (1990) |
| X54223 | | AttB-related site | Cianciotto, N. et al. "DNA sequence homology between att B-related sites of Cornybacterium diphtheriae, Corynebacterium ulcerans, Corynebacterium glutamicum, and the attP site of lambdacorynephage," FEMS. Microbiol, Lett., 66:299–302 (1990) |
| X54740 | argS; lysA | Arginyl-tRNA synthetase; Diaminopimelate decarboxylase | Marcel, T. et al. "Nucleotide sequence and organization of the upstream region of the Corynebacterium glutamicum lysA gene," Mol. Microbiol, 4(11):1819–1830 (1990) |
| X55994 | trpL; trpE | Putative leader peptide; anthranilate synthase component 1 | Heery, D.M. et al. "Nucleotide sequence of the Corynebacterium glutamicum trpE gene," Nucleic Acids Res, 18(23):7138 (1990) |
| X56037 | thrC | Threonine synthase | Han, K.S. et al. "The molecular structure of the Corynebacterium glutamicum threonine synthase gene," Mol. Microbiol., 4(10):1693–1702 (1990) |
| X56075 | attB-related site | Attachment site | Cianciotto, N. et al. "DNA sequence homology between att B-related sites of Cornybacterium diphtheriae, Corynebacterium ulcerans, Corynebacterium glutamicum, and the attP site of lambdacorynephage," FEMS. Microbiol, Lett., 66:299–302 (1990) |
| X57226 | lysC-alpha; lysC-beta; asd | Aspartokinase-alpha subunit; Aspartokinase-beta subunit; aspartate beta semialdehyde dehydrogenase | Kalinowski, J. et al. "Genetic and biochemical analysis of the Aspartokinase from Corynebacterium glutamicum," Mol. Microbiol. 5(5):1197–1204 (1991); Kalinowski, J. et al. "Aspartokinase genes lysC alpha and lysC beta overlap and are adjacent to the aspertate beta-semialdehyde dehydrogenase gene asd in Corneybacterium glutamicum," Mol. Gen. Genet., 224(3):317–324 (1990) |
| X59403 | gap;pgk; tpi | Glyceraldehyde-3-phosphate; phosphoglycerate kinase; triosephosphate isomerase | Eikmanns, B.J. "Identification, sequence analysis, and expression of a Corynebacterium glutamicum gene cluster encoding the three glycolytic enzymes glyceraldehyde-3-phosphate dehydrogenase, 3-phosphoglycerate kinase, and triosephosphate isomeras," J. Bacteriol., 174(19):6076–6086 (1992) |
| X59404 | gdh | Glutamate dehydrogenase | Bormann, E.R. et al. "Molecular analysis of the Cornybacterium glutamicum gdh gene encoding glutamate dehydrogenase," Mol. Microbiol., 6(3):317–326 (1992) |

TABLE 2-continued

GENES IDENTIFIED FROM GENBANK

| GenBank® Accession No. | Gene Name | Gene Function | Reference |
|---|---|---|---|
| X60312 | lysI | L-lysine permease | Seep-Feldhaus, A.H. et al. "Molecular analysis of the *Corynebacterium glutamicum* lysI gene involved in lysine uptake," Mol. Microbiol., 5(12):2995–3005 (1991) |
| X66078 | cop1 | Ps1 protein | Joliff, G. et al. "Cloning and nucleotide sequence of the csp1 gene encoding PS1, one of the two major secreted proteins of *Corynebacterium glutamicum*: The deduced N-terminal region of PS1 is similar to the Mycobacterium antigen 85 complex," Mol. Microbiol., 6(16):2349–2362 (1992) |
| X66112 | glt | Citrate synthase | Eikmanns, B.J. et al. "Cloning sequence, expression and transcriptional analysis of the *Corynebacterium glutamicum* gltA gene encoding citrate synthase," Microbiol., 140:1817–1828 (1994) |
| X67737 X69103 | dapB csp2 | Dihydrodipicolinate reductase Surface layer protein PS2 | Peyret, J.L. et al. "Characterization of the cspB gene encoding PS2, an ordered surface-layer protein in *Corynebacterium glutamicum*," Mol. Microbiol., 9(1):97–109 (1993) |
| X69104 | | IS3 related insertion element | Bonamy, C. et al. "Identification of IS1206, a *Corynebacterium glutamicum* IS3-related insertion sequence and phylogenetic analysis," Mol. Microbiol., 14(3):571–581 (1994) |
| X70959 | leuA | Isopropylmalate synthase | Patek, M. et al. "Leucine synthesis in *Corynebacterium glutamicum*: enzyme activities, structure of leuA, and effect of leuA inactivation on lysine synthesis," Appl. Environ. Microbiol., 60(1):133–140 (1994) |
| X71489 | icd | Isocitrate dehydrogenase (NADP+) | Eikmanns, B.J. et al. "Cloning sequence analysis, expression, and inactivation of the *Corynebacterium glutamicum* icd gene encoding isocitrate dehydrogenase and biochemical characterization of the enzyme," J. Bacteriol., 177(3):774–782 (1995) |
| X72855 X75083, X70584 | GDHA mtrA | Glutamate dehydrogenase (NADP+) 5-methyltryptophan resistance | Heery, D.M. et al. "A sequence from a tryptophan-hyperproducing strain of *Corynebacterium glutamicum* encoding resistance to 5-methyltryptophan," Biochem. Biophys. Res. Commun., 201(3):1255–1262 (1994) |
| X75085 | recA | | Fitzpatrick, R. et al. "Construction and characterization of recA mutant strains of *Corynebacterium glutamicum* and *Brevibacterium lactofermentum*," Appl. Microbiol. Biotechnol., 42(4):575–580 (1994) |
| X75504 | aceA; thiX | Partial Isocitrate lyase; ? | Reinscheid, D.J. et al. "Characterization of the isocitrate lyase gene from *Corynebacterium glutamicum* and biochemical analysis of the enzyme," J. Bacteriol., 176(12):3474–3483 (1994) |
| X76875 | | ATPase beta-subunit | Ludwig, W. et al. "Phylogenetic relationships of bacteria based on comparative sequence analysis of elongation factor Tu and ATP-synthase beta-subunit genes," Antonie Van Leeuwenhoek, 64:285–305 (1993) |
| X77034 | tuf | Elongation factor Tu | Ludwig, W. et al. "Phylogenetic relationships of bacteria based on comparative sequence analysis of elongation factur Tu and ATP-synthase beta-subunit genes," Antonie Van Leeuwenhoek, 64:285–305 (1993) |
| X77384 | recA | | Billman-Jacobe, H. "Nucleotide sequence of a recA gene from *Corynebacterium glutamicum*," DNA Seq., 4(6):403–404 (1994) |
| X78491 | aceB | Malate synthase | Reinscheid, D.J. et al. "Malate synthase from *Corynebacterium glutamicum* pta-ack operon encoding phosphotransacetylase: sequence analysis," Microbiology, 140:3099–3108 (1994) |

TABLE 2-continued

GENES IDENTIFIED FROM GENBANK

| GenBank® Accession No. | Gene Name | Gene Function | Reference |
|---|---|---|---|
| X80629 | 16S rDNA | 16S ribosomal RNA | Rainey, F.A. et al. "Phylogenetic analysis of the genera Rhodococcus and Nocardia and evidence for the evolutionary origin of the genus Norcardia from within the radiation of Rhodococcus species," Microbial., 141:523–528 (1995) |
| X81191 | gluA; gluB; gluC; gluD | Glutamate uptake system | Kronemeyer, W. et al. "Structure of the gluABCD cluster encoding the glutamate uptake system of Corynebacterium glutamicum," J. Bacteriol., 177(5):1152–1158 (1995) |
| X81379 | dapE | Succinyldiaminopimelate desuccinylase | Wehrmann, A. et al. "Analysis of different DNA fragments of Corynebacterium glutamicum complementing dapE of Escherichia coli," Microbiology, 40:3349–56 (1994) |
| X82061 | 16S rDNA | 16S ribosomal RNA | Ruimy, R. et al. "Phylogeny of the genus Corynebacterium deduced from analyses of small-subunit ribosomal DNA sequences," Int. J. Syst. Bacteriol., 45(4):740–746 (1995) |
| X82928 | asd; lysC | Aspartate-semialdehyde dehydrogenase; ? | Serebrujski, I. et al. "Multicopy suppression by asd gene and osmotic stress-dependent complementation by heterologous proA in proA mutants," J. Bacteriol., 177(24)7255–7260 (1995) |
| X82929 | proA | Gamma-glutamyl phosphate reductase | Serebrijski, I. et al. "Multicopy suppression by asd gene and osmotic stress-dependent complementation by heterologous proA in proA mutants," J. Bacteriol., 177(24):7255–7260 (1995) |
| X84257 | 16S rDNA | 16S ribosomal RNA | Pascual, C. et al. "Phylogenetic analysis of the genus Corynebacterium based on 16S rRNA gene sequences," Int. J. Syst. Bacteriol., 45(4):724–728 (1995) |
| X85965 | aroP; dapE | Aromatic amino acid permease; ? | Wehrmann, A. et al. "Functional analysis of sequences adjacent to dapE of Corynebacterium glutamicumproline reveals the presence of aroP, which encodes the aromatic amino acid transporter," J. Bacteriol, 177(20):5991–5993 (1995) |
| X86157 | argB; argC; argD; argF; argJ | Acetylglutamate kinase; N-acetyl-gamma-glutamyl-phosphate reductase; acetylornithine aminotransferase; ornithine carbamoyltransferase; glutamate N-acetyltransferase | Sakanyan, V. et al. "Genes and enzymes of the acetyl cycle of arginine biosynthesis in Corynebacterium glutamicum: enzyme evolution in the early steps of the arginine pathway," Microbiology, 142:99–108 (1996) |
| X89084 | pta; ackA | Phosphate acetyltransferase; acetate kinase | Reinscheid, D.J. et al. "Cloning, sequence analysis, expression and inactivation of the Corynebacterium glutamicum pta-ack operon encoding phosphotransacetylase and acetate kinase," Microbiology, 145:503–513 (1999) |
| X89850 | attB | Attachment site | Le Marree, C. et al. "Genetic characterization of site-specific integration functions of phi AAU2 infecting "Arthrobacter aureus C70," J. Bacteriol., 178(7):1996–2004 (1996) |
| X90356 | | Promoter fragment F1 | Patek, M. et al. "Promoters from Corynebacterium glutamicum: cloning, molecular analysis and search for a consensus motif," Microbiology, 142:1297–1309 (1996) |
| X90357 | | Promoter fragment F2 | Patek, M. et al. "Promoters from Corynebacterium glutamicum: cloning, molecular analysis and search for a consensus motif," Microbiology, 142:1297–1309 (1996) |
| X90358 | | Promoter fragment F10 | Patek, M. et al. "Promoters from Corynebacterium glutamicum: cloning, molecular analysis and search for a consensus motif," Microbiology, 142:1297–1309 (1996) |

TABLE 2-continued

GENES IDENTIFIED FROM GENBANK

| GenBank® Accession No. | Gene Name | Gene Function | Reference |
|---|---|---|---|
| X90359 | | Promoter fragment F13 | Patek, M. et al. "Promoters from *Corynebacterium glutamicum*: cloning, molecular analysis and search for consensus motif," Microbiology, 142:1297–1309 (1996) |
| X90360 | | Promoter fragment F22 | Patek, M. et al. "Promoters from *Corynebacterium glutamicum*: cloning, molecular analysis and search for consensus motif," Microbiology, 142:1297–1309 (1996) |
| X90361 | | Promoter fragment F34 | Patek, M. et al. "Promoters from *Corynebacterium glutamicum*: cloning, molecular analysis and search for consensus motif," Microbiology, 142:1297–1309 (1996) |
| X90362 | | Promoter fragment F37 | Patek, M. et al. "Promoters from *Corynebacterium glutamicum*: cloning, molecular analysis and search for consensus motif," Microbiology, 142:1297–1309 (1996) |
| X90363 | | Promoter fragment F45 | Patek, M. et al. "Promoters from *Corynebacterium glutamicum*: cloning, molecular analysis and search for consensus motif," Microbiology, 142:1297–1309 (1996) |
| X90364 | | Promoter fragment F64 | Patek, M. et al. "Promoters from *Corynebacterium glutamicum*: cloning, molecular analysis and search for consensus motif," Microbiology, 142:1297–1309 (1996) |
| X90365 | | Promoter fragment F75 | Patek, M. et al. "Promoters from *Corynebacterium glutamicum*: cloning, molecular analysis and search for consensus motif," Microbiology, 142:1297–1309 (1996) |
| X90366 | | Promoter fragment F101 | Patek, M. et al. "Promoters from *Corynebacterium glutamicum*: cloning, molecular analysis and search for consensus motif," Microbiology, 142:1297–1309 (1996) |
| X90367 | | Promoter fragment F104 | Patek, M. et al. "Promoters from *Corynebacterium glutamicum*: cloning, molecular analysis and search for consensus motif," Microbiology, 142:1297–1309 (1996) |
| X90368 | | Promoter fragment F109 | Patek, M. et al. "Promoters from *Corynebacterium glutamicum*: cloning, molecular analysis and search for consensus motif," Microbiology, 142:1297–1309 (1996) |
| X93513 | amt | Ammonium transport system | Siewe, R.M. et al. "Functional and genetic characterization of the (methyl) ammonium uptake carrier of *Corynebacterium glutamicum*," J. Biol. Chem., 271(10):5398–5403 (1996) |
| X93514 | betP | Glycine betaine transport system | Peter, H. et al. "Isolation, characterization, and expression of the *Corynebacterium glutamicum* betP gene, encoding the transport system for the compatible solute glycine betaine," J. Bacteriol., 178(17):5229–5234 (1996) |
| X95649 | orf4 | | Patek, M. et al. "Identification and transcriptional analysis of the dapB-ORF2-dapA-ORF4 operon of *Corynebacterium glutamicum*, encoding two enzymes involved in L-lysine synthesis," Biotechnol. Lett., 19:1113–1117 (1997) |
| X96471 | lysE; lysG | Lysine exporter protein; Lysine export regulator protein | Vrljic, M. et al. "A new type of transporter with a new type of cellular function: L-lysine export from *Corynebacterium glutamicum*," Mol. Microbiol., 22(5):815–826 (1996) |

TABLE 2-continued

GENES IDENTIFIED FROM GENBANK

| GenBank® Accession No. | Gene Name | Gene Function | Reference |
|---|---|---|---|
| X96580 | panB; panC; xylB | 3-methyl-2-oxobutanoate hydroxymethyltransferase; pantoate-beta-alanine ligase; xylulokinase | Sahm, H. et al. "D-pantothenate synthesis in *Corynebacterium glutamicum* and use of panBC and genes encoding L-valine synthesis for D-pantothenate overproduction," Appl. Environ. Microbiol., 65(5): 1973–1979 (1999) |
| X06962 | | Insertion sequence IS1207 and transposase | |
| X99289 | | Elongation factor P | Ramos, A. et al. "Cloning, sequencing and expression of the gene encoding elongation factor P in the amino-acid producer *Brevibacterium lactofermentum* (*Corynebacterium glutamicum* ATCC 13869)," Gene, 198:217–222 (1997) |
| Y00140 | thrB | Homoserine kinase | Mateos, L.M. et al. "Nucleotide sequence of the homoserine kinase (thrB) gene of the *Brevibacterium lactofermentum*," Nucleic Acids Res, 15(9):3922 (1987) |
| Y00151 | ddh | Meso-diaminopikelate D-dehydrogenase (EC 1.4.1.16) | Ishino, S. et al. "Nucleotide sequence of the meso-diaminopimelate D-dehydrogenase gene from *Corynebacterium glutamicum*," Nucleic Acids Res, 15(9):3917 (1987) |
| Y00476 | thrA | Homoserine dehydrogenase | Meteos, L.M. et al. "Nucleotide sequence of the homoserine dehydrogenase (thrA) gene of the *Brevibacterium lactofermentum*," Nucleic Acids Res, 15(24):10598 (1987) |
| Y00546 | hom; thrB | Homoserine dehydrogenase; homoserine kinase | Peoples, O.P. et al. "Nucleotide sequence and fine structural analysis of the *Corynebacterium glutamicum* hom-thrB operon," Mol. Microbiol., 2(1):63–72 (1988) |
| Y08964 | murC; ftsQ/divD; ftsZ | UPD-N-acetylmuramate-alanine ligase; division initiation protein or cell division protein; cell division protein | Honrubia, M.P. et al. "Identification, characterization, and chromosomal organization of the ftsZ gene from *Brevibacterium lactofermentum*," Mol. Gen. Genet., 259(1):97–104 (1998) |
| Y09163 | putP | High affinity proline transport system | Peter, H. et al. "Isolation of the putP gene of *Corynebacterium glutamicumproline* and characterization of a low-affinity uptake system for compatible solutes," Arch. Microbiol., 168(2):143–151 (1997) |
| Y09548 | pyc | Pyruvate carboxylase | Peters-Wendisch, P.G. et al. "Pyruvate carboxylase from *Corynebacterium glutamicum*: characterization, expression and inactivation of the pyc gene," Microbiology, 144:915–927 (1998) |
| Y09578 | leuB | 3-isopropylmalate dehydrogenase | Patek, M. et al. "Analysis of the leuB gene from *Corynebacterium glutamicum*," Appl. Microbiol. Biotechnol., 50(1):42–47 (1998) |
| Y12472 | | Attachment site bacteriophage Phi-16 | Moreau, S. et al. "Site-specific integration of corynephage Phi-16: The construction of an integration vector," Microbiol., 145:539–548 (1999) |
| Y12537 | proP | Proline/ectoine uptake system protein | Peter, H. et al. "*Corynebacterium glutamicum* is equipped with four secondary carriers for compatible solutes: Identification, sequencing, and characterization of the proline/ectoine uptake system, ProP, and the ectoine/proline/glycine betaine carrier, EctP," J. Bacteriol., 180(22):6005–6012 (1998) |
| Y13221 | glnA | Glutamine synthetase I | Jakoby, M. et al. "Isolation of *Corynebacterium glutamicum* glnA gene encoding glutamine synthetase I," FEMS Microbiol. Lett., 154(1):81–88 (1997) |
| Y16642 | lpd | Dihydrolipoamide dehydrogenase | |
| Y18059 | | Attachment site Corynephage 304L | Moreau, S. et al. "Analysis of the integration functions of φ304L: An integrase module among corynephages," Virology, 255(1):150–159 (1999) |
| Z21501 | argS; lysA | Arginyl-tRNA synthetase; diaminopimelate decarboxylase (partial) | Oguiza, J.A. et al. "A gene encoding arginyl-tRNA synthetase is located in the upstream region of arg-S-lysA cluster expression by arginine," J. Bacteriol., 175(22):7356–7362 (1993) |

TABLE 2-continued

GENES IDENTIFIED FROM GENBANK

| GenBank® Accession No. | Gene Name | Gene Function | Reference |
| --- | --- | --- | --- |
| Z21502 | dapA; dapB | Dihydrodipicolinate synthase; dihydrodipicolinate reductase | Pisabarro A. et al. "A cluster of three genes (dapA, orf2, and dapB) of *Brevibacterium lactofermentum* encodes dihydrodipicolinate reductase, and a third polypeptide of unknown function," J. Bacteriol., 175(9):2743–2749 (1993) |
| Z29563 | thrC | Threonine synthase | Malumbres, M. et al. "Analysis and expression of the thrC gene of the encoded threonine synthase," Appl. Environ. Microbiol., 60(7)209–219 (1994) |
| Z46753 | 16S rDNA | Gene for 16S ribosomal RNA | |
| Z49822 | sigA | SigA sigma factor | Oguiza, J.A. et al "Multiple sigma factor genes in *Brevibacterium lactofermentum*: Characterization of sigA and sigB," J. Bacteriol., 178(2):550–553 (1996) |
| Z49823 | galE; dtxR | Catalytic activity UDP-galactose 4-epimerase; diphtheria toxin regulatory protein | Oguiza, J.A. et al "The galE gene encoding the UDP-galactose 4-epimerase of *Brevibacterium lactofermentum* is coupled transcriptionally to the dmdR gene," Gene, 177:103–107 (1996) |
| Z49824 | orf1; sigB | ?; SigB sigma factor | Oguiza, J.A. et al "Multiple sigma factor genes in *Brevibacterium lactofermentum*: Characterization of sigA and sigB," J. Bacteriol., 178(2):550–553 (1996) |
| Z66534 | | Transposase | Correia, A. et al. "Cloning and characterization of an IS-like element present in the genome of *Brevibacterium lactofermentum* ATCC 13869," Gene, 170(1):91–94 (1996) |

[1]A sequence for this gene was published in the indicated reference. However, the sequence obtained by the inventors of the present application is significantly longer than the published version. It is believed that the published version relied on an incorrect start codon, and thus represents only a fragment of the actual coding region.

TABLE 3

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Brevibacterium | ammoniagenes | 21054 | | | | | | | |
| Brevibacterium | ammoniagenes | 19350 | | | | | | | |
| Brevibacterium | ammoniagenes | 19351 | | | | | | | |
| Brevibacterium | ammoniagenes | 19352 | | | | | | | |
| Brevibacterium | ammoniagenes | 19353 | | | | | | | |
| Brevibacterium | ammoniagenes | 19354 | | | | | | | |
| Brevibacterium | ammoniagenes | 19355 | | | | | | | |
| Brevibacterium | ammoniagenes | 19356 | | | | | | | |
| Brevibacterium | ammoniagenes | 21055 | | | | | | | |
| Brevibacterium | ammoniagenes | 21077 | | | | | | | |
| Brevibacterium | ammoniagenes | 21553 | | | | | | | |
| Brevibacterium | ammoniagenes | 21580 | | | | | | | |
| Brevibacterium | ammoniagenes | 39101 | | | | | | | |
| Brevibacterium | butanicum | 21196 | | | | | | | |
| Brevibacterium | divaricatum | 21792 | P298 | | | | | | |
| Brevibacterium | flavum | 21474 | | | | | | | |
| Brevibacterium | flavum | 21129 | | | | | | | |
| Brevibacterium | flavum | | | | | | | | |
| Brevibacterium | flavum | | | B11477 | | | | | |
| Brevibacterium | flavum | | | B11478 | | | | | |
| Brevibacterium | flavum | 21127 | | | | | | | |
| Brevibacterium | flavum | 21128 | | | | | | | |
| Brevibacterium | flavum | 21427 | | | | | | | |
| Brevibacterium | flavum | 21475 | | | | | | | |
| Brevibacterium | flavum | 21517 | | | | | | | |
| Brevibacterium | flavum | 21528 | | | | | | | |
| Brevibacterium | flavum | 21529 | | | | | | | |
| Brevibacterium | flavum | | | B11477 | | | | | |
| Brevibacterium | flavum | | | B11478 | | | | | |
| Brevibacterium | flavum | 21127 | | | | | | | |
| Brevibacterium | flavum | | | B11474 | | | | | |
| Brevibacterium | healii | 15527 | | | | | | | |
| Brevibacterium | ketoglutamicum | 21004 | | | | | | | |
| Brevibacterium | ketoglutamicum | 21089 | | | | | | | |
| Brevibacterium | ketosoreductum | 21914 | | | | | | | |
| Brevibacterium | lactofermentum | | | | 70 | | | | |
| Brevibacterium | lactofermentum | | | | 74 | | | | |
| Brevibacterium | lactofermentum | | | | 77 | | | | |
| Brevibacterium | lactofermentum | 21798 | | | | | | | |
| Brevibacterium | lactofermentum | 21799 | | | | | | | |
| Brevibacterium | lactofermentum | 21800 | | | | | | | |
| Brevibacterium | lactofermentum | 21801 | | | | | | | |
| Brevibacterium | lactofermentum | | | B11470 | | | | | |
| Brevibacterium | lactofermentum | | | B11471 | | | | | |
| Brevibacterium | lactofermentum | 21086 | | | | | | | |
| Brevibacterium | lactofermentum | 21420 | | | | | | | |
| Brevibacterium | lactofermentum | 21086 | | | | | | | |
| Brevibacterium | lactofermentum | 31269 | | | | | | | |
| Brevibacterium | linens | 9174 | | | | | | | |
| Brevibacterium | linens | 19391 | | | | | | | |
| Brevibacterium | linens | 8377 | | | | | | | |
| Brevibacterium | paraffinolyticum | | | | | 11160 | | | |
| Brevibacterium | spec. | | | | | | 717.73 | | |
| Brevibacterium | spec. | | | | | | 717.73 | | |
| Brevibacterium | spec. | 14604 | | | | | | | |
| Brevibacterium | spec. | 21860 | | | | | | | |
| Brevibacterium | spec. | 21864 | | | | | | | |
| Brevibacterium | spec. | 21865 | | | | | | | |
| Brevibacterium | spec. | 21866 | | | | | | | |
| Brevibacterium | spec. | 19240 | | | | | | | |
| Corynebacterium | acetoacidophilum | 21476 | | | | | | | |
| Corynebacterium | acetoacidophilum | 13870 | | | | | | | |
| Corynebacterium | acetoglutamicum | | | B11473 | | | | | |
| Corynebacterium | acetoglutamicum | | | B11475 | | | | | |
| Corynebacterium | acetoglutamicum | 15806 | | | | | | | |
| Corynebacterium | acetoglutamicum | 21491 | | | | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Corynebacterium | acetoglutamicum | 31270 | | | | | | | |
| Corynebacterium | acetophilum | | | B3671 | | | | | |
| Corynebacterium | ammoniagenes | 6872 | | | | | | | 2399 |
| Corynebacterium | ammoniagenes | 15511 | | | | | | | |
| Corynebacterium | fujiokense | 21496 | | | | | | | |
| Corynebacterium | glutamicum | 14067 | | | | | | | |
| Corynebacterium | glutamicum | 39137 | | | | | | | |
| Corynebacterium | glutamicum | 21254 | | | | | | | |
| Corynebacterium | glutamicum | 21255 | | | | | | | |
| Corynebacterium | glutamicum | 31830 | | | | | | | |
| Corynebacterium | glutamicum | 13032 | | | | | | | |
| Corynebacterium | glutamicum | 14305 | | | | | | | |
| Corynebacterium | glutamicum | 15455 | | | | | | | |
| Corynebacterium | glutamicum | 13058 | | | | | | | |
| Corynebacterium | glutamicum | 13059 | | | | | | | |
| Corynebacterium | glutamicum | 13060 | | | | | | | |
| Corynebacterium | glutamicum | 21492 | | | | | | | |
| Corynebacterium | glutamicum | 21513 | | | | | | | |
| Corynebacterium | glutamicum | 21526 | | | | | | | |
| Corynebacterium | glutamicum | 21543 | | | | | | | |
| Corynebacterium | glutamicum | 13287 | | | | | | | |
| Corynebacterium | glutamicum | 21851 | | | | | | | |
| Corynebacterium | glutamicum | 21253 | | | | | | | |
| Corynebacterium | glutamicum | 21514 | | | | | | | |
| Corynebacterium | glutamicum | 21516 | | | | | | | |
| Corynebacterium | glutamicum | 21299 | | | | | | | |
| Corynebacterium | glutamicum | 21300 | | | | | | | |
| Corynebacterium | glutamicum | 39684 | | | | | | | |
| Corynebacterium | glutamicum | 21488 | | | | | | | |
| Corynebacterium | glutamicum | 21649 | | | | | | | |
| Corynebacterium | glutamicum | 21650 | | | | | | | |
| Corynebacterium | glutamicum | 19223 | | | | | | | |
| Corynebacterium | glutamicum | 13869 | | | | | | | |
| Corynebacterium | glutamicum | 21157 | | | | | | | |
| Corynebacterium | glutamicum | 21158 | | | | | | | |
| Corynebacterium | glutamicum | 21159 | | | | | | | |
| Corynebacterium | glutamicum | 21355 | | | | | | | |
| Corynebacterium | glutamicum | 31808 | | | | | | | |
| Corynebacterium | glutamicum | 21674 | | | | | | | |
| Corynebacterium | glutamicum | 21562 | | | | | | | |
| Corynebacterium | glutamicum | 21563 | | | | | | | |
| Corynebacterium | glutamicum | 21564 | | | | | | | |
| Corynebacterium | glutamicum | 21565 | | | | | | | |
| Corynebacterium | glutamicum | 21566 | | | | | | | |
| Corynebacterium | glutamicum | 21567 | | | | | | | |
| Corynebacterium | glutamicum | 21568 | | | | | | | |
| Corynebacterium | glutamicum | 21569 | | | | | | | |
| Corynebacterium | glutamicum | 21570 | | | | | | | |
| Corynebacterium | glutamicum | 21571 | | | | | | | |
| Corynebacterium | glutamicum | 21572 | | | | | | | |
| Corynebacterium | glutamicum | 21573 | | | | | | | |
| Corynebacterium | glutamicum | 21579 | | | | | | | |
| Corynebacterium | glutamicum | 19049 | | | | | | | |
| Corynebacterium | glutamicum | 19050 | | | | | | | |
| Corynebacterium | glutamicum | 19051 | | | | | | | |
| Corynebacterium | glutamicum | 19052 | | | | | | | |
| Corynebacterium | glutamicum | 19053 | | | | | | | |
| Corynebacterium | glutamicum | 19054 | | | | | | | |
| Corynebacterium | glutamicum | 19055 | | | | | | | |
| Corynebacterium | glutamicum | 19056 | | | | | | | |
| Corynebacterium | glutamicum | 19057 | | | | | | | |
| Corynebacterium | glutamicum | 19058 | | | | | | | |
| Corynebacterium | glutamicum | 19059 | | | | | | | |
| Corynebacterium | glutamicum | 19060 | | | | | | | |
| Corynebacterium | glutamicum | 19185 | | | | | | | |
| Corynebacterium | glutamicum | 13286 | | | | | | | |

TABLE 3-continued

Corynebacterium and Brevibacterium Strains Which May be Used in the Practice of the Invention

| Genus | species | ATCC | FERM | NRRL | CECT | NCIMB | CBS | NCTC | DSMZ |
|---|---|---|---|---|---|---|---|---|---|
| Corynebacterium | glutamicum | 21515 | | | | | | | |
| Corynebacterium | glutamicum | 21527 | | | | | | | |
| Corynebacterium | glutamicum | 21544 | | | | | | | |
| Corynebacterium | glutamicum | 21492 | | | | | | | |
| Corynebacterium | glutamicum | | | B8183 | | | | | |
| Corynebacterium | glutamicum | | | B8182 | | | | | |
| Corynebacterium | glutamicum | | | B12416 | | | | | |
| Corynebacterium | glutamicum | | | B12417 | | | | | |
| Corynebacterium | glutamicum | | | B12418 | | | | | |
| Corynebacterium | glutamicum | | | B11476 | | | | | |
| Corynebacterium | glutamicum | 21608 | | | | | | | |
| Corynebacterium | lilium | | P973 | | | | | | |
| Corynebacterium | nitrilophilus | 21419 | | | | 11594 | | | |
| Corynebacterium | spec. | | P4445 | | | | | | |
| Corynebacterium | spec. | | P4446 | | | | | | |
| Corynebacterium | spec. | 31088 | | | | | | | |
| Corynebacterium | spec. | 31089 | | | | | | | |
| Corynebacterium | spec. | 31090 | | | | | | | |
| Corynebacterium | spec. | 31090 | | | | | | | |
| Corynebacterium | spec. | 31090 | | | | | | | |
| Corynebacterium | spec. | 15954 | | | | | | | 20145 |
| Corynebacterium | spec. | 21857 | | | | | | | |
| Corynebacterium | spec. | 21862 | | | | | | | |
| Corynebacterium | spec. | 21863 | | | | | | | |

ATCC: American Type Culture Collection, Rockville, MD, USA

FERM: Fermentation Research Institute, Chiba, Japan

NRRL: ARS Culture Collection, Northern Regional Research Laboratory, Peoria, IL, USA CECT: Coleccion Espanola de Cultivos Tipo, Valencia, Spain NCIMB: National Collection of Industrial and Marine Bacteria Ltd., Aberdeen, UK CBS: Centraalbureau voor Schimmelcultures, Baarn, NL NCTC: National Collection of Type Cultures, London, UK DSMZ: Deutsche Sammlung von Mikroorganismen und Zellkulturen, Braunschweig, Germany For reference see Sugawara, H. et al. (1993) World directory of collections of cultures of microorganisms: Bacteria, fungi and yeasts (4th edn), World federation for culture collections world data center on microorganisms, Saimata, Japen.

TABLE 4

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00051 | 1527 | GB_HTG3:AC009685 | 210031 | AC009685 | *Homo sapiens* chromosome 15 clone 91_E_13 map 15, *SEQUENCING IN PROGRESS*, 27 unordered pieces. | *Homo sapiens* | 34,247 | 29 Sep. 1999 |
| | | GB_HTG3:AC009685 | 210031 | AC009685 | *Homo sapiens* chromosome 15 clone 91_E_13 map 15, *SEQUENCING IN PROGRESS*, 27 unordered pieces. | *Homo sapiens* | 34,247 | 29 Sep. 1999 |
| | | GB_HTG7:AC009511 | 271896 | AC009511 | *Homo sapiens* chromosome 15 clone 91_E_13 map 15, *SEQUENCING IN PROGRESS*, 59 unordered pieces. | *Homo sapiens* | 35,033 | 09 Dec. 1999 |
| rxa00091 | 876 | GB_BA1:D50453 | 146191 | D50453 | *Bacillus subtilis* DNA for 25–36 degree region containing the amyE-srfA region, complete cds. | *Bacillus subtilis* | 54,452 | 10 Feb. 1999 |
| | | GB_BA1:SCI51 | 40745 | AL109848 | *Streptomyces coelicolor* cosmid 151. | *Streptomyces coelicolor* A3(2) | 36,806 | 16 Aug. 1999 |
| | | GB_BA1:ECOUW93 | 338534 | U14003 | *Escherichia coli* K-12 chromosomal region from 92.8 to 00.1 minutes. | *Escherichia coli* | 38,642 | 17 Apr. 1996 |
| rxa00092 | 789 | GB_BA1:SCH35 | 45396 | AL078610 | *Streptomyces coelicolor* cosmid H35. | *Streptomyces coelicolor* | 49,934 | 4 Jun. 1999 |
| | | GB_HTG3:AC011498_0 | 312343 | AC011498 | *Homo sapiens* chromosome 19 clone CIT978SKB_50L17, *SEQUENCING IN PROGRESS*, 190 unordered pieces. | *Homo sapiens* | 37,117 | 13 Dec. 1999 |
| | | GB_HTG3:AC011498_0 | 312343 | AC011498 | *Homo sapiens* chromosome 19 clone CIT978SKB_50L17, *SEQUENCING IN PROGRESS*, 190 unordered pieces. | *Homo sapiens* | 37,117 | 13 Dec. 1999 |
| rxa00104 | 879 | GB_BA1:MTCY270 | 37586 | Z95388 | *Mycobacterium tuberculosis* H37Rv complete genome; segment 96/162. | *Mycobacterium tuberculosis* | 36,732 | 10 Feb. 1999 |
| | | GB_PL2:T24M8 | 68251 | AF077409 | *Arabidopsis thaliana* BAC T24M8. | *Arabidopsis thaliana* | 37,150 | 3 Aug. 1998 |
| | | GB_BA1:MTCY270 | 37586 | Z95388 | *Mycobacterium tuberculosis* H37Rv complete genome; segment 96/162. | *Mycobacterium tuberculosis* | 42,874 | 10 Feb. 1999 |
| rxa00113 | 5745 | GB_BA1:MAFASGEN | 10520 | X87822 | *B. ammoniagenes* FAS gene. | *Corynebacterium ammoniagenes* | 68,381 | 03 Oct. 1996 |
| | | GB_BA1:BAFASAA | 10549 | X64795 | *B. ammoniagenes* FAS gene. | *Corynebacterium ammoniagenes* | 57,259 | 14 Oct. 1997 |
| | | GB_BA1:MTCY159 | 33818 | Z83863 | *Mycobacterium tuberculosis* H37Rv complete genome; segment 111/162. | *Mycobacterium tuberculosis* | 39,870 | 17 Jun. 1998 |
| rxa00164 | 1812 | GB_HTG2:HSJ1153D9 | 118360 | AL109806 | *Homo sapiens* chromosome 20 clone RP5-1153D9, *SEQUENCING IN PROGRESS*, in unordered pieces. | *Homo sapiens* | 35,714 | 03 Dec. 1999 |
| | | GB_HTG2:HSJ1153D9 | 118360 | AL109806 | *Homo sapiens* chromosome 20 clone RP5-1153D9, *SEQUENCING IN PROGRESS*, in unordered pieces. | *Homo sapiens* | 35,714 | 03 Dec. 1999 |
| | | GB_HTG2:HSJ1153D9 | 118360 | AL109806 | *Homo sapiens* chromosome 20 clone RP5-1153D9, *SEQUENCING IN PROGRESS*, in unordered pieces. | *Homo sapiens* | 35,534 | 03 Dec. 1999 |
| rxa00181 | 1695 | GB_BA1:CGPUTP | 3791 | Y09163 | *C. glutamicum* putP gene. | *Corynebacterium glutamicum* | 100,000 | 8 Sep. 1997 |
| | | GB_BA2:U32814 | 10393 | U32814 | *Haemophilus influenzae* Rd section 129 of 163 of the complete genome. | *Haemophophilus influenzae* Rd | 36,347 | 20 May 1998 |
| rxa00186 | 870 | GB_BA1:CGPUTP | 3791 | Y09163 | *C. glutamicum* putP gene. | *Corynebacterium glutamicum* | 37,454 | 8 Sep. 1997 |
| | | GB_PR3:AC004843 | 136655 | AC004843 | *Homo sapiens* PAC clone DJ0612F12 from 7p12-p14, complete sequence. | *Homo sapiens* | 37,315 | 5 Nov. 1998 |
| | | GB_HTG2:HS745I14 | 133309 | AL033532 | *Homo sapiens* chromosome 1 clone RP4-74I14, map q23.1-24.3, *SEQUENCING IN PROGRESS*, in unordered pieces. | *Homo sapiens* | 38,129 | 03 Dec. 1999 |
| | | GB_HTG2:HS745I14 | 133309 | AL033532 | *Homo sapiens* chromosome 1 clone RP4-74I14, map q23.1-24.3, *SEQUENCING IN PROGRESS*, in unordered pieces. | *Homo sapiens* | 38,129 | 03 Dec. 1999 |
| rxa00187 | 474 | GB_GSS10:AQ184082 | 506 | AQ184082 | HS_3216_A1_G08_T7 CIT Approved Human Genomic Sperm Library D *Homo sapiens* genomic clone Plate = 3216 Col = 15 Row = M, genomic survey sequence. | *Homo sapiens* | 37,297 | 1 Nov. 1998 |

TABLE 4-continued

ALIGNMENT RESULTS

| ID # | length (NT) | Genbank Hit | Length Accession | Name of Genbank Hit | Source of Genbank Hit | % homology (GAP) | Date of Deposit |
|---|---|---|---|---|---|---|---|
| | | GB_GSS1:CNS008ZZ | 1101 AL052951 | *Drosophila melanogaster* genome survey sequence T7 end of BAC # BACR18L01 of RPCI-98 library from *Drosophila melanogaster* (fruit fly). genomic survey sequence. | *Drosophila melanogaster* | 34,120 | 3 Jun. 1999 |
| | | GB_GSS10:AQ184082 | 506 AQ184082 | HS_3216_A1_G08_T7 CIT Approved Human Genomic Sperm Library D *Homo sapiens* genomic clone Plate = 3216 Col = 15 Row = M, genomic survey sequence. | *Homo sapiens* | 39,655 | 1 Nov. 1998 |
| rxa00201 | 292 | GB_PR3:HSJ824F16 | 139330 AL050325 | Human DNA sequence from clone 824F16 on chromosome 20, complete sequence. | *Homo sapiens* | 34,520 | 23 Nov. 1999 |
| | | GB_BA1:RCSECA | 2724 X89411 | *R. capsulatus* DNA for secA gene. | *Rhodobacter capsulatus* | 38,163 | 6 Jan. 1996 |
| | | GB_EST34:AV122904 | 242 AB122904 | AV122904 *Mus musculus* C57BL/6J 10-day embryo *Mus musculus* cDNA clone 2610529H07, mRNA sequence. | *Mus musculus* | 38,889 | 1 Jul. 1999 |
| rxa00228 | 714 | GB_EST15:AA486042 | 515 AA486042 | ab40c08.r1 Stratagene HeLa cell s3 937216 *Homo sapiens* cDNA clone IMAGE:843278 5', mRNA sequence. | *Homo sapiens* | 37,500 | 06 Mar. 1998 |
| | | GB_EST15:AA486042 | 515 AA486042 | ab40c08.r1 Stratagene HeLa cell s3 937216 *Homo sapiens* cDNA clone IMAGE:843278 5', mRNA sequence. | *Homo sapiens* | 38,816 | 06 Mar. 1998 |
| rxa00243 | 1140 | GB_PR2:CNS01DS5 | 101584 AL121655 | BAC sequence from the SPG4 candidate region at 2p21–2p22, complete sequence. | *Homo sapiens* | 37,001 | 29 Sep. 1999 |
| | | GB_HTG3:AC011408 | 79332 AC011408 | *Homo sapiens* clone CIT978SKB_65D22, *SEQUENCING IN PROGRESS*, 10 unordered pieces. | *Homo sapiens* | 38,040 | 06 Oct. 1999 |
| | | GB_HTG3:AC011408 | 79332 AC011408 | *Homo sapiens* clone CIT978SKB_65D22, *SEQUENCING IN PROGRESS*, 10 unordered pieces. | *Homo sapiens* | 38,040 | 06 Oct. 1999 |
| rxa00259 | 2325 | GB_HTG1:CEY62E10 | 254217 AL031580 | *Caenorhabditis elegans* chromosome IV clone Y62E10, *SEQUENCING IN PROGRESS*, in unordered pieces. | *Caenorhabditis elegans* | 36,776 | 6 Sep. 1999 |
| | | GB_HTG1:CEY62E10 | 254217 AL031580 | *Caenorhabditis elegans* chromosome IV clone Y62E10, *SEQUENCING IN PROGRESS*, in unordered pieces. | *Caenorhabditis elegans* | 36,776 | 6 Sep. 1999 |
| | | GB_PL2:YSCCHROMI | 41988 L22015 | *Saccharomyces cerevisiae* chromosome I centromere and right arm sequence. | *Saccharomyces cerevisiae* | 39,260 | 05 Mar. 1998 |
| rxa00269 | 912 | GB_HTG4:AC009974 | 219565 AC009974 | *Homo sapiens* chromosome unkown clone NH0459I19, WORKING DRAFT SEQUENCE, in unordered pieces. | *Homo sapiens* | 37,358 | 29 Oct. 1999 |
| | | GB_HTG4:AC009974 | 219565 AC009974 | *Homo sapiens* chromosome unkown clone NH0459I19, WORKING DRAFT SEQUENCE, in unordered pieces. | *Homo sapiens* | 37,358 | 29 Oct. 1999 |
| | | GB_BA1:AB017508 | 32050 AB017508 | *Bacillus halodurans* C-125 genomic DNA, 32kb fragment, complete cds. | *Bacillus halodurans* | 44,622 | 14 Apr. 1999 |
| rxa00281 | 766 | GB_BA1:SCE8 | 24700 AL035654 | *Streptomyces coelicolor* cosmid E8. | *Streptomyces coelicolor* | 36,328 | 11 Mar. 1999 |
| | | GB_BA1:SCU51332 | 3216 U51332 | *Streptomyces coelicolor* histidine kinase homolog (absA1) and response regulator homolog (absA2) genes, complete cds. | *Streptomyces coelicolor* | 39,089 | 14 Sep. 1996 |
| | | GB_HTG4:AC011122 | 187123 AC011122 | *Homo sapiens* chromosome 8 clone 23_D_19 map 8, *SEQUENCING IN PROGRESS*, 27 ordered pieces. | *Homo sapiens* | 38,658 | 14 Oct. 1999 |
| rxa00298 | 1968 | GB_BA1:CGECTP | 2719 AJ001436 | *Corynebacterium glutamicum* ectP gene. | *Corynebacterium glutamicum* | 100,000 | 20 Nov. 1998 |
| | | GB_BA1:CGECTP | 2719 AJ001436 | *Corynebacterium glutamicum* ectP gene. | *Corynebacterium glutamicum* | 100,000 | 20 Nov. 1998 |
| | | GB_EST24:AI234006 | 432 AI234006 | EST230694 Normalized rat lung, Bento Soares Rattus. sp. cDNA clone RLUCU01 3' end, mRNA sequence. | *Rattus* sp. | 46,552 | 31 Jan. 1999 |
| rxa00346 | 813 | GB_BA1:SC2E9 | 20850 AL021530 | *Streptomyces coelicolor* cosmid 2E9. | *Streptomyces coelicolor* | 43,267 | 28 Jan. 1998 |
| | | GB_BA1:SC9B1 | 24800 AL049727 | *Streptomyces coelicolor* cosmid 9B1. | *Streptomyces coelicolor* | 44,613 | 27 Apr. 1999 |
| | | GB_BA1:ECU70214 | 123171 U70214 | *Escherichia coli* chromosome minutes 4–6. | *Escherichia coli* | 39,490 | 21 Sep. 1996 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00368 | 1698 | GB_BA2:AF065159 | 35209 | AF065159 | *Bradyrhizobium japonicum* putative arylsulfatase (arsA), putative soluble lytic transglycosylase precursor (sltA), dihydrodipicolinate synthase (dapA), MscL (mscL), SmpB (smpB), BcpB (bcpB), RnpO (rnpO), RelA/SpoT homolog (relA), PdxJ (pdxJ), and acyl carrier protein synthase AcpS (scpS) genes, complete cds; prokaryotic type I signal peptidase SipF (sipF) gene, sipF–sipS allele, complete cds; RNase III (rnc) gene, complete cds; GTP-binding protein Era (era) gene, partial cds; and unknown genes. | *Bradyrhizobium japonicum* | 40,409 | 27 Oct. 1999 |
| | | GB_BA1:AEOCHIT1 | 6861 | D63139 | *Aeromonas* sp. gene for chitinase, complete and partial cds. | *Aeromonas* sp. 10S-24 | 38,577 | 13 Feb. 1999 |
| | | GB_EST4:D62996 | 314 | D62996 | HUM347G01B Clontech human aorta polyA+ mRNA (#6572) *Homo sapiens* cDNA clone GEN-347G01 5', mRNA sequence. | *Homo sapiens* | 41,613 | 29 Aug. 1995 |
| rxa00369 | 817 | GB_BA1:YP102KB | 119443 | AL031866 | *Yersinia pestis* 102 kbases unstable region: from 1 to 119443. | *Yersinia pestis* | 35,396 | 4 Jan. 1999 |
| | | GB_GSS8:AQ012142 | 501 | AQ012142 | 8750H1A037010398 Cosmid library of chromosome II *Rhodobacter sphaeroides* genomic clone 8750H1A037010398, genomic survey sequence. | *Rhodobacter sphaeroides* | 54,800 | 4 Jan. 1999 |
| rxa00410 | 789 | GB_HTG2:AC005081 | 180096 | AC005081 | *Homo sapiens* clone RG270D13, *SEQUENCING IN PROGRESS*, 18 unordered pieces. | *Homo sapiens* | 45,786 | 12 Jun. 1998 |
| | | GB_BA1:APTLOCC | 8870 | Z30328 | *A. tumefaciens* Ti plasmid pTIAch5 genes for OccR, OccQ, OccM, OccP, OccT, OoxB, OoxA and ornithine cyclodeaminase. | *Agrobacterium tumefaciens* | 46,490 | 10 Oct. 1994 |
| rxa00419 | 882 | GB_BA2:U67591 | 9829 | U67591 | *Methanococcus jannaschii* section 133 of 150 of the complete genome. | *Methanococcus jannaschii* | 45,677 | 28 Jan. 1998 |
| | | GB_BA1:TIPOCCQMPJ | 4350 | M80607 | Plasmid pTIA6 (from *Agrobacterium tumefaciens*) periplasmic-type octopine permease (occK, occQ, occM, occP, and occJ) and lysR-type regulatory protein (occR) genes, complete cds. | Plasmid pTIA6 | 46,490 | 24 Apr. 1996 |
| | | GB_BA2:MSU46844 | 16951 | U46844 | *Mycobacterium smegmatis* catalase-peroxidase (katG), putative arabinosyl transferase (embC, embA, embB), genes complete cds and putative propionyl-coA carboxylase beta chain (pccB) genes, partial cds. | *Mycobacterium smegmatis* | 57,029 | 12 May 1997 |
| rxa00432 | 1608 | GB_EST28:AI513245 | 471 | AI513245 | GH13311.3prime GH *Drosophila melanogaster* head pOT2 *Drosophila melanogaster* cDNA clone GH1g3311 3 prime, mRNA sequence. | *Drosophila melanogaster* | 37,696 | 16 Mar. 1999 |
| | | GB_HTG4:AC010066 | 187240 | AC010066 | *Drosophila melanogaster* chromosome 3L/72A4 clone RPCI98-25O1, *SEQUENCING IN PROGRESS*, 70 unordered pieces. | *Drosophila melanogaster* | 39,607 | 16 Oct. 1999 |
| rxa00449 | 1704 | GB_BA1:BSUB0015 | 218410 | Z99118 | *Bacillus subtilis* complete genome (section 15 of 21): from 2795131 to 3013540. | *Bacillus subtilis* | 49,810 | 26 Nov. 1997 |
| | | GB_PL1:CAC35A5 | 42565 | AL033396 | *C. albicans* cosmid Ca35A5. | *Candida albicans* | 35,041 | 5 Nov. 1998 |
| | | GB_EST13:AA336266 | 378 | AA336266 | EST40981 Endometrial tumor *Homo sapiens* cDNA 5' end, mRNA sequence. | *Homo sapiens* | 39,733 | 21 Apr. 1997 |
| | | GB_HTG2:AC008199 | 124050 | AC008199 | *Drosophila melanogaster* chromosome 3 clone BACR01K08 (D756) RPCI-98 01.K.8 map 94D—94D strain y; cn bw sp, *SEQUENCING IN PROGRESS*, 83 unordered pieces. | *Drosophila melanogaster* | 38,392 | 2 Aug. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG2:AC008199 | 124050 | AC008199 | *Drosophila melanogaster* chromosome 3 clone BACR01K08 (D756) RPCI-98 01.K.8 map 94D—94D strain y; cn bw sp, *SEQUENCING IN PROGRESS*, 83 unordered pieces. | *Drosophila melanogaster* | 38,392 | 2 Aug. 1999 |
| rxa00456 | 1500 | GB_RO:RATLNKP2 | 177 | M22337 | Rat link protein gene, exon 2. | *Rattus* sp. | 40,678 | 27 Apr. 1993 |
| | | GB_GSS1:FR0030597 | 476 | AL026966 | *Fugu rubripes* GSS sequence, clone 091C22aF9, genomic survey sequence. | *Fugu rubripes* | 47,407 | 25 Jun. 1998 |
| | | GB_G555:AQ786587 | 556 | AQ786587 | HS_3086_B1_H05_MR CIT Approved Human Genomic Sperm Library D *Homo sapiens* genomic clone Plate = 3086 Col = 9 Row = P, genomic survey sequence. | *Homo sapiens* | 38,406 | 3 Aug. 199 |
| | | GB_GSS14:AQ526586 | 434 | AQ526586 | HS_5198_B1_B03_SP6E RPCI-11 Human Male BAC Library *Homo sapiens* genomic clone Plate = 774 Col = 5 Row = D, genomic survey sequence. | *Homo sapiens* | 36,951 | 11 May 1999 |
| rxa00477 | 1767 | GB_EST17:AA610489 | 407 | AA610489 | np93e05.s1 NCL_CGAP_Thy1 *Homo sapiens* cDNA clone IMAGE:1133888 similar to gb:M11353 HISTONE H3.3 (HUMAN); mRNA sequence. | *Homo sapiens* | 41,791 | 09 Dec. 1997 |
| | | GB_PR1:HSH33G4 | 1015 | X05857 | Human H3.3 gene exon 4. | *Homo sapiens* | 38,182 | 24 Jan. 1996 |
| | | GB_EST30:AI637667 | 579 | AI637667 | tt10g11.x1 NCL_CGAP_GC6 *Homo sapiens* cDNA clone IMAGE:2240420 3', mRNA sequence. | *Homo sapiens* | 35,417 | 27 Apr. 1999 |
| rxa00478 | 954 | GB_HTG3:AC008708 | 83932 | AC008708 | *Homo sapiens* chromosome 5 clone CIT978SKB_78F1, *SEQUENCING IN PROGRESS*, 12 unordered pieces. | *Homo sapiens* | 38,769 | 3 Aug. 1999 |
| | | GB_HTG3:AC008708 | 83932 | AC008708 | *Homo sapiens* chromosome 5 clone CIT978SKB_78F1, *SEQUENCING IN PROGRESS*, 12 unordered pieces. | *Homo sapiens* | 38,769 | 3 Aug. 1999 |
| | | GB_HTG3:AC008708 | 83932 | AC008708 | *Homo sapiens* chromosome 5 clone CIT978SKB_78F1, *SEQUENCING IN PROGRESS*, 12 unordered pieces. | *Homo sapiens* | 36,797 | 3 Aug. 1999 |
| rxa00480 | 1239 | GB_HTG1:HSJ575L21 | 94715 | AL096841 | *Homo sapiens* chromosome 1 clone RP4-575L21, *SEQUENCING IN PROGRESS*, in unordered pieces. | *Homo sapiens* | 38,138 | 23 Nov. 1999 |
| | | GB_HTG1:HSJ57SL21 | 94715 | AL096841 | *Homo sapiens* chromosome 1 clone RP4-575L21, *SEQUENCING IN PROGRESS*, in unordered pieces. | *Homo sapiens* | 38,138 | 23 Nov. 1999 |
| | | GB_RO:AC005960 | 158414 | AC005960 | *Mus musculus* chromosome 17 BAC ciib20h22 from the MHC region, complete sequence. | *Mus musculus* | 38,712 | 01 Dec. 1998 |
| rxa00524 | 433 | GB_BA1:SCI51 | 40745 | AL109848 | *Streptomyces coelicolor* cosmid 151. | *Streptomyces coelicolor* A3(2) | 40,284 | 16 Aug. 1999 |
| | | GB_BA2:AF082879 | 3434 | AF082879 | *Yersinia enterocolitica* ABC transporter enterochelin/enterobactin gene cluster, complete sequence. | *Yersinia enterocolitica* | 55,634 | 20 Oct. 1999 |
| rxa00526 | 813 | GB_BA1:BSP132617 | 5192 | AJ132617 | *Burkholderia* sp. P-transporter operon and flanking genes. | *Burkholderia* sp. | 40,793 | 13 Jul. 1999 |
| | | GB_BA1:BSUB0008 | 208230 | Z99111 | *Bacillus subtilis* complete genome (section 8 of 21): from 1394791 to 1603020. | *Bacillus subtilis* | 54,534 | 26 Noc. 1997 |
| | | GB_BA2:AF012285 | 46864 | AF012285 | *Bacillus subtilis* mobA-nptE gene region. | *Bacillus subtilis* | 54,534 | 1 Jul. 1998 |
| | | GB_BA1:D90725 | 13798 | D90725 | *Escherichia coli* genomic DNA. (19.7–20.0 min). | *Escherichia coli* | 51,481 | 7 Feb. 1998 |
| rxa00559 | 1140 | GB_BA2:CAU77910 | 3385 | U77910 | *Corynebacterium ammoniagenes* sequence upstream of the 5-phosphoribosyl-1-pyrophosphate amidotransferase (purF) gene. | *Corynebacterium ammoniagenes* | 39,007 | 1 Jan. 1998 |
| | | GB_EST4:H34952 | 382 | H34952 | EST108261Rat PC-12 cells, untreated *Rattus* sp. cDNA clone RPCCK07 similar to NADH-ubiquinone oxidoreductase complex I 23kDa precursor (iron-sulfur protein), mRNA sequence. | *Rattus* sp. | 39,267 | 2 Apr. 1998 |
| | | GB_BA2:AE000963 | 22014 | AE000963 | *Archaeoglobus fulgidus* section 144 of 172 of the complete genome. | *Archaeoglobus fulgidus* | 38,338 | 15 Dec. 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00570 | 852 | GB_GSS12:AQ422451 | 563 | AQ422451 | RPCI-11-185C3.TV RPCI-11 Homo sapiens genomic clone RPCI-11-185C3, genomic survey sequence. | Homo sapiens | 38,767 | 23 Mar. 1999 |
| | | GB_EST28:AI504741 | 568 | AI504741 | vl16c01.x1 Stratagene mouse T cell 937311 Mus musculus cDNA clone IMAGE:972384 3' similar to gb:Z14044 Mus musculus mRNA for valosin-containing protein (MOUSE); mRNA sequence. | Mus musculus | 37,900 | 11 Mar. 1999 |
| | | GB_EST18:AA712043 | 68 | AA712043 | vu29f10r1 Barstead mouse myotubes MPLRB5 Mus musculus cDNA clone IMAGE:1182091 5' similar to gb:L05093 60S RIBOSOMAL PROTEIN L18A (HUMAN); mRNA sequence. | Mus musculus | 42,647 | 24 Dec. 1997 |
| rxa00571 | 1280 | GB_BA1:MTCY78 | 33818 | Z77165 | Mycobacterium tuberculosis H37Rv complete genome; segment 145/162. | Mycobacterium tuberculosis | 38,468 | 17 Jun. 1998 |
| | | GB_PR3:AC005788 | 36224 | AC005788 | Homo sapiens chromosome 19, cosmid R26652, complete sequence. | Homo sapiens | 36,911 | 06 Oct. 1998 |
| | | GB_PR3:AC005338 | 34541 | AC005338 | Homo sapiens chromosome 19, cosmid R31646, complete sequence. | Homo sapiens | 36,911 | 30 Jul. 1998 |
| rxa 00590 | 1288 | GB_HTG6:AC010932 | 203273 | AC010932 | Homo sapiens chromosome 15, clone RP11-296E22 map 15, *SEQUENCING IN PROGRESS*, 36 unordered pieces. | Homo sapiens | 37,242 | 30 Nov. 1999 |
| | | GB_HTG6:AC010932 | 203273 | AC010932 | Homo sapiens chromosome 15, clone RP11-296E22 map 15, *SEQUENCING IN PROGRESS*, 36 unordered pieces. | Homo sapiens | 36,485 | 30 Nov. 1999 |
| rxa00591 | 1476 | GB_BA1:MSGB26CS | 37040 | L78816 | Mycobacterium leprae cosmid B26 DNA sequence. | Mycobacterium leprae | 39,272 | 15 Jun. 1996 |
| | | GB_IN1:CEK09E9 | 30098 | Z79602 | Caenorhabditis elegans cosmid K09E9, complete sequence. | Caenorhabditis elegans | 34,092 | 2 Sep. 1999 |
| | | GB_PR4:AF135802 | 4965 | AF135802 | Homo sapiens thyroid hormone receptor-assicciated protein complex component TRAP170 mRNA, complete cds. | Homo sapiens | 36,310 | 9 Apr. 1999 |
| | | GB_PR4:AF104256 | 4365 | AF104256 | Homo sapiens transcriptional co-activator CRSP150 (CRSP150) mRNA, complete cds. | Homo sapiens | 36,617 | 4 Feb. 1999 |
| rxa00596 | 576 | GB_PR3:AC004659 | 129577 | AC004659 | Homo sapiens chromosome 19, CIT-HSP-87m17 BAC clone, complete sequence. | Homo sapiens | 34,321 | 02 May 1998 |
| | | GB_PR3:AC004659 | 129577 | AC004659 | Homo sapiens chromosome 19, CIT-HSP-87m17 BAC clone, complete sequence. | Homo sapiens | 35,739 | 02 May 1998 |
| rxa00607 | 504 | GB_PR1:HUMCBP2 | 2047 | D83174 | Human mRNA for collagen binding protein 2, complete cds. | Homo sapiens | 40,404 | 6 Feb. 1999 |
| | | GB_BA1:MTV010 | 3400 | AL021186 | Mycobacterium tuberculosis H37Rv complete genome; segment 119/162. | Mycobacterium tuberculosis | 40,862 | 23 Jun. 1999 |
| | | GB_BA1:MTV010 | 3400 | AL021186 | Mycobacterium tuberculosis H37Rv complete genome; segment 119/162. | Mycobacterium tuberculosis | 38,833 | 23 Jun. 1999 |
| rxa00623 | 1461 | GB_BA1:MTCY428 | 26914 | Z81451 | Mycobacterium tuberculosis H37Rv complete genome; segment 107/162. | Mycobacterium tuberculosis | 60,552 | 17 Jun. 1998 |
| | | GB_BA1:RSPNGR234 | 34010 | Z68203 | Rhizobium sp. plasmid NGR234a DNA. | Rhizobium sp. | 51,992 | 8 Aug. 1996 |
| | | GB_BA2:AE000101 | 10057 | AE000101 | Rhizobium sp. NGR234 plasmid NGR234a, section 38 of 46 of the complete plasmid sequence. | Rhizobium sp. NGR234 | 51,992 | 12 Dec. 1997 |
| rxa00681 | | | | | | | | |
| rxa00690 | 1269 | GB_HTG5:AC008338 | 136685 | AC008338 | Drosophila melanogaster chromosome X clone BACR30J04 (D908) RPCI-98 30.J.4 map 19C–19E strain y; cn bw sp, *SEQUENCING IN PROGRESS*, 93 unordered pieces. | Drosophila melanogaster | 35,341 | 15 Nov. 1999 |
| | | GB_HTG4:AC009766 | 170502 | AC009766 | Homo sapiens chromosome 11 clone 404_A_03 map 11, *SEQUENCING IN PROGRESS*, 27 unordered pieces. | Homo sapiens | 37,984 | 19 Oct. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG4:AC009766 | 170502 | AC009766 | Homo sapiens chromosome 11 clone 404_A_03 map 11, *SEQUENCING IN PROGRESS*, 27 unordered pieces. | Homo sapiens | 37,984 | 19 Oct. 1999 |
| rxa00733 | 1008 | GB_EST30:AU054038 | 245 | AU054038 | AU054038 Dictyostelium discoideum SL (H. Urushihara) Dictyostelium discoideum cDNA clone SLK472, mRNA sequence. | Dictyostelium discoideum | 43,265 | 28 Apr. 1999 |
| | | GB_EST30:AU054038 | 245 | AU054038 | AU054038 Dictyostelium discoideum SL (H. Urushihara) Dictyostelium discoideum cDNA clone SLK472, mRNA sequence. | Dictyostelium discoideum | 43,265 | 28 Apr. 1999 |
| rxa00735 | 692 | GB_BA1:MTCY50 | 36030 | Z77137 | Mycobacterium tuberculosis H37Rv complete genome; segment 55/162. | Mycobacterium tuberculosis | 36,819 | 17 Jun. 1998 |
| | | GB_BA1:D90904 | 150894 | D90904 | Synechocystis sp. PCC6803 complete genome, 6/27, 630555–781448. | Synechocystis sp. | 52,585 | 7 Feb. 1999 |
| | | GB_BA1:D90904 | 150894 | D90904 | Synechocystis sp. PCC6803 complete genome, 6/27, 630555–781448. | Synechocystis sp. | 39,699 | 7 Feb. 1999 |
| rxa00796 | 298 | GB_GSS14:AQ579838 | 651 | AQ579838 | T135342b shotgun sub-library of BAC clone 31P06 Medicago truncatula genomic clone 31-P-06-C-054, genomic survey sequence. | Medicago truncatula | 37,153 | 27 Sep. 1999 |
| | | GB_PR4:AC007625 | 174701 | AC007625 | Genomic sequence of Homo sapiens clones 2314F2 from chromosome 18, complete sequence. | Homo sapiens | 38,014 | 30 Jun. 1999 |
| | | GB_EST14:AA427576 | 580 | AA427576 | zw54b04.s1 Soares_total_fetus_Nb2HF8_9w Homo sapiens cDNA clone IMAGE:773839 3' similar to gb:M86652 PEROXISOME ASSEMBLY FACTOR-1 (HUMAN); mRNA sequence. | Homo sapiens | 42,731 | 16 Oct. 1997 |
| rxa00801 | 756 | GB_BA1:MTV022 | 13025 | AL021925 | Mycobacterium tuberculosis H37Rv complete genome; segment 100/162. | Mycobacterium tuberculosis | 59,350 | 17 Jun. 1998 |
| | | GB_RO:AC002109 | 160048 | AC002109 | Genomic sequence from Mouse 9, complete sequence. | Mus musculus | 39,398 | 9 Sep. 1997 |
| | | GB_BA1:MTV022 | 13025 | AL021925 | Mycobacterium tuberculosis H37Rv complete genome; segment 100/162. | Mycobacterium tuberculosis | 36,842 | 17 Jun. 1998 |
| rxa00802 | 837 | GB_GSS14:AQ563349 | 642 | AQ563349 | HS_5335_B2_A09_T7A RPCI-11 Human Male BAC Library Homo sapiens genomic clone Plate = 911 Col = 18 Row = B, genomic survey sequence. | Homo sapiens | 37,649 | 29 May 1999 |
| | | GB_BA1:DIHCLPBA | 2441 | M32229 | B. nodosus clpB gene encoding a regulatory subunit of ATP-dependent protease. | Dichelobacter nodosus | 41,140 | 26 Apr. 1993 |
| | | GB_GSS3:B61538 | 698 | B61538 | T17M17TR TAMU Arabidopsis thaliana genomic clone T17M17, genomic survey sequence. | Arabidopsis thaliana | 36,946 | 21 Nov. 1997 |
| rxa00819 | 1452 | GB_HTG3:AC008691 | 110000 | AC008691 | Homo sapiens chromosome 5 clone CIT978SKB_63A22, *SEQUENCING IN PROGRESS*, 253 unordered pieces. | Homo sapiens | 38,270 | 3 Aug. 1999 |
| | | GB_HTG3:AC008691_1 | 110000 | AC008691 | Homo sapiens chromosome 5 clone CIT978SKB_63A22, *SEQUENCING IN PROGRESS*, 253 unordered pieces. | Homo sapiens | 38,270 | 3 Aug. 1999 |
| | | GB_HTG3:AC009127 | 186591 | AC009127 | Homo sapiens chromosome 16 clone RPCI-11_498D10, *SEQUENCING IN PROGRESS*, 49 unordered pieces. | Homo sapiens | 38,947 | 3 Aug. 1999 |
| rxa00821 | 966 | GB_HTG1:HS32B1 | 271488 | AL023693 | Homo sapiens chromosome 6 clone RP1-32B1, *SEQUENCING IN PROGRESS*, in unordered pieces. | Homo sapiens | 36,565 | 23 Nov. 1999 |
| | | GB_HTG1:HS32B1 | 271488 | AL023693 | Homo sapiens chromosome 6 clone RP1-32B1, *SEQUENCING IN PROGRESS*, in unordered pieces. | Homo sapiens | 36,565 | 23 Nov. 1999 |
| | | GB_PR3:AC004919 | 75547 | AC004919 | Homo sapiens PAC clone DJ0895B23 from U1, complete sequence. | Homo sapiens | 34,346 | 19 Sep. 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00827 | 876 | GB_EST6:W06539 | 300 | W06539 | T2367 MVAT4 bloodstream form of serodeme WRATat1.1 Trypanosoma brucei rhodesiense cDNA 5', mRNA sequence. | Trypanosoma brucei rhodesiense | 40,000 | 12 Aug. 1996 |
|  |  | GB_PR4:AC008179 | 181745 | AC008179 | Homo sapiens clone NH0576F01, complete sequence. | Homo sapiens | 35,903 | 28 Sep. 1999 |
|  |  | GB_EST18:AA710415 | 533 | AA710415 | vt53t08r1 Barstead mouse irradiated colon MPLRB7 Mus musculus cDNA clone IMAGE:1166823 5', mRNA sequence. | Mus musculus | 41,562 | 28 Sep. 1999 |
| rxa00842 | 1323 | GB_PR2:AC002379 | 118595 | AC002379 | Human BAC clone GS165I04 from 7q21, complete sequence. | Homo sapiens | 36,321 | 23 Jul. 1997 |
|  |  | GB_PR2:AC002379 | 118595 | AC002379 | Human BAC clone GS165I04 from 7q21, complete sequence. | Homo sapiens | 36,321 | 23 Jul. 1997 |
|  |  | GB_IN1:CEF02D8 | 31624 | Z78411 | Caenorhabditis elegans cosmid F02D8, complete sequence. | Caenorhabditis elegans | 38,163 | 23 Nov. 1998 |
| rxa00847 | 1572 | GB_OV:XELRDS38A | 1209 | L79915 | Xenopus laevis rds/peripherin (rds38) mRNA, complete cds. | Xenopus laevis | 36,044 | 30 Jul. 1997 |
|  |  | GB_HTG4:AC007920 | 234529 | AC007920 | Homo sapiens chromosome 3q27 clone RPCI11-208N14, *SEQUENCING IN PROGRESS*, 51 unordered pieces. | Homo sapiens | 33,742 | 21 Oct. 1999 |
|  |  | GB_HTG4:AC007920 | 234529 | AC007920 | Homo sapiens chromosome 3q27 clone RPCI11-208N14, *SEQUENCING IN PROGRESS*, 51 unordered pieces. | Homo sapiens | 33,742 | 21 Oct. 1999 |
| rxa00851 | 732 | GB_HTG2:AC004064 | 185000 | AC004064 | Homo sapiens chromosome 4, *SEQUENCING IN PROGRESS*, 10 unordered pieces. | Homo sapiens | 39,833 | 9 Jul. 1998 |
|  |  | GB_HTG2:AC004064 | 185000 | AC004064 | Homo sapiens chromosome 4, *SEQUENCING IN PROGRESS*, 10 unordered pieces. | Homo sapiens | 39,833 | 9 Jul. 1998 |
|  |  | GB_PR3:HSJ824F16 | 139330 | AL050325 | Human DNA sequence from clone 824F16 on chromosome 20, complete sequence. | Homo sapiens | 39,833 | 23 Nov. 1999 |
| rxa00852 | 813 | GB_HTG3:AC010120 | 121582 | AC010120 | Drosophila melanogaster chromosome 3 clone BACR22N13 (D1061) RPCI-98 22.N.13 map 96F—96F strain y; cn bw sp, *SEQUENCING IN PROGRESS*, 83 unordered pieces. | Drosophila melanogaster | 36,855 | 24 Sep. 1999 |
|  |  | GB_HTG3:AC010120 | 121582 | AC010120 | Drosophila melanogaster chromosome 3 clone BACR22N13 (D1061) RPCI-98 22.N.13 map 96F—96F strain y; cn bw sp, *SEQUENCING IN PROGRESS*, 83 unordered pieces. | Drosophila melanogaster | 36,855 | 24 Sep. 1999 |
|  |  | GB_HTG2:AC006898 | 299308 | AC006898 | Caenorhabditis elegans clone Y73B6x, *SEQUENCING IN PROGRESS*, 9 unordered pieces. | Caenorhabditis elegans | 36,768 | 24 Feb. 1999 |
| rxa00856 |  |  |  |  |  |  |  |  |
| rxa00870 | 1635 | GB_BA1:STMMSDA | 3986 | L48550 | Streptomyces coelicofor methylmalonic acid semialdehyde dehydrogenase (msdA) gene, complete cds. | Streptomyces coelicolor | 63,743 | 09 May 1996 |
|  |  | GB_PAT:I92043 | 713 | I92043 | Sequence 10 from U.S. Pat. No. 5726299. | Unknown. | 38,850 | 01 Dec. 1998 |
|  |  | GB_PAT:I78754 | 713 | I78754 | Sequence 10 from U.S. Pat. No. 5693781. | Unknown. | 38,850 | 3 Apr. 1998 |
| rxa00875 | 690 | GB_BA2:AF119715 | 549 | AF119715 | Escherichia coli isopentyl diphosphate isomerase (idi) gene, complete cds. | Escherichia coli | 54,827 | 22 Apr. 1999 |
|  |  | GB_BA2:AE000372 | 12144 | AE000372 | Escherichia coli K-12 MG 1655 section 262 of 400 of the complete genome. | Escherichia coli | 51,416 | 12 Nov. 1998 |
|  |  | GB_BA1:ECU28375 | 55175 | U28375 | Escherichia coli K-12 genome, approximately 64 to 65 minutes. | Escherichia coli | 51416 | 08 Dec. 1995 |
| rxa00878 | 1986 | GB_HTG2:AC007472 | 114003 | AC007472 | Drosophila melanogaster chromosome 2 clone BACR30D19 (D587) RPCI-98 30.D.19 map 49E–49F strain y, cn bw sp, *SEQUENCING IN PROGRESS*, 79 unordered pieces. | Drosophila melanogaster | 36,592 | 2 Aug. 1999 |
|  |  | GB_HTG2:AC007472 | 114003 | AC007472 | Drosophila melanogaster chromosome 2 clone BACR30D19 (D587) RPCI-98 30.D.19 map 49E–49F strain y, cn bw sp, *SEQUENCING IN PROGRESS*, 79 unordered pieces. | Drosophila melanogaster | 36,592 | 2 Aug. 1999 |
|  |  | GB_HTG2:AC006798 | 207370 | AC006798 | Caenorhabditis elegans clone Y51F8, *SEQUENCING IN PROGRESS*, 30 unordered pieces. | Caenorhabditis elegans | 36,699 | 25 Feb. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa00880 | 1968 | GB_EST4:H22888 | 468 | H22888 | ym54e12.r1 Soares infant brain 1NIB *Homo sapiens* cDNA clone IMAGE:52158 5′, mRNA sequence. | *Homo sapiens* | 37,179 | 6 Jul. 1995 |
|  |  | GB_GSS13:AQ426858 | 516 | AQ426858 | CITBI-E1-2578F1.TF CITBI-E1 *Homo sapiens* genomic clone 2578F1, genomic survey sequence. | *Homo sapiens* | 38,447 | 24 Mar. 1999 |
| rxa00899 | 1389 | GB_PR1:AB002335 | 6289 | AB002335 | Human mRNA for KIAA0337 gene, complete cds. | *Homo sapiens* | 35,799 | 13 Feb. 1999 |
|  |  | GB_BA1:NGU58849 | 2401 | U58849 | *Neisseria gonorrhoeae* pilS6 silent pilus locus. | *Neisseria gonorrhoeae* | 40,623 | 20 Jun. 1996 |
|  |  | GB_BA1:PLPDHOS | 3119 | L06822 | Plasmid pSa (from *Escherichia coli*) dihydropteroate synthase gene, 3′ end. | Plasmid pSa | 38,966 | 20 Mar. 1996 |
|  |  | GB_BA1:PDGINTORF | 6747 | L06418 | Integron Tn7 (from Plasmid pDGO100 from *Escherichia coli*) integrase (int), aminoglycoside adenylyltransferase (aad), quaternary ammonium compound-resistance protein, dihydrofolate reductase (dhfrx), and dihydropteroate synthase (sull) genes. | Plasmid pDGO100 | 38,966 | 20 Mar. 1996 |
| rxa00902 | 1333 | GB_GSS15:AQ606873 | 581 | AQ606873 | HS_5404_B2_H05_T7A RPCI-11 Human Male BAC Library *Homo sapiens* genomic clone Plate = 980 Col = 10 Row = P, genomic survey sequence. | *Homo sapiens* | 37,900 | 10 Jun. 1999 |
|  |  | GB_GSS9:AQ163442 | 658 | AQ163442 | nbxb0007A07f CUGI Rice BAC Library *Oryza sativa* genomic clone nbxb0007A07f, genomic survey sequence. | *Oryza sativa* | 41,885 | 12 Sep. 1998 |
| rxa00931 | 969 | GB_PLI:PSST70 | 4974 | X69213 | *P. sativum* Psst70 gene for heat-shock protein. | *Pisum sativum* | 36,866 | 3 Jul. 1996 |
|  |  | GB_GSS1:FR0025208 | 612 | AL018047 | *F. rubripes* GSS sequence, clone 145D10aA8, genomic survey sequence. | *Fugu rubripes* | 37,815 | 10 Dec. 1997 |
|  |  | GB_GSS1:FR0021844 | 252 | AL014715 | *F. rubripes* GSS sequence, clone 069K22aG5, genomic survey sequence. | *Fugu rubripes* | 37,698 | 10 Dec. 1997 |
|  |  | GB_GSS12:AQ403344 | 593 | AQ403344 | HS_2257_B1_B03_T7C CIT Approved Human Genomic Sperm Library D *Homo sapiens* genomic clone Plate = 2257 Col = 5 Row = D, genomic survey sequence. | *Homo sapiens* | 31,552 | 13 Mar. 1999 |
| rxa00941 | 1440 | GB_BA1:MTCY180 | 44201 | Z97193 | *Mycobacterium tuberculosis* H37Rv complete genome; segment 85/162. | *Mycobacterium tuberculosis* | 37,902 | 17 Jun. 1998 |
|  |  | GB_BA1:MTCY180 | 44201 | Z97193 | *Mycobacterium tuberculosis* H37Rv complete genome; segment 85/162. | *Mycobacterium tuberculosis* | 39,140 | 17 Jun. 1998 |
|  |  | GB_BA2:MSGKATG | 1745 | L14268 | *Mycobacterium tuberculosis* ethyl methane sulphonate resistance protein (katG) gene, 3′ end. | *Mycobacterium tuberculosis* | 42,517 | 26 Aug. 199 |
| rxa00962 | 689 | GB_HTG6:AC010998 | 144338 | AC010998 | *Homo sapiens* clone RP11-95I16, *SEQUENCING IN PROGRESS*, 17 unordered pieces. | *Homo sapiens* | 39,497 | 08 Dec. 1999 |
|  |  | GB_GSS1:GGA340111 | 990 | AJ232089 | *Gallus gallus* anonymous sequence from Cosmid mapping to chromosome 2 (Cosmid 34 - Contig 15), genomic survey sequence. | *Gallus gallus* | 37,970 | 25 Aug. 1998 |
|  |  | GB_HTG6:AC010998 | 144338 | AC010998 | *Homo sapiens* clone RP11-95I16, *SEQUENCING IN PROGRESS*, 17 unordered pieces. | *Homo sapiens* | 38,226 | 08 Dec. 1999 |
| rxa01060 | 1047 | GB_BA1:ECTTN7 | 2280 | AJ001816 | *Escherichia Coli* left end of transposon Tn7 including type 2 integron. | *Escherichia coli* | 38,822 | 4 Nov. 1997 |
|  |  | GB_IN2:AF176377 | 8220 | AF176377 | *Caenorhabditis briggsae* CES-1 (ces-1) gene, complete cds; and CPN-1 (cpn-1) gene, partial cds. | *Caenorhabditis briggsae* | 39,921 | 09 Dec. 1999 |
|  |  | GB_GSS10:AQ196728 | 429 | AQ196728 | CIT-HSP-2381F4.TR CIT-HSP *Homo sapiens* genomic clone 2381F4, genomic survey sequence. | *Homo sapiens* | 39,019 | 16 Sep. 1998 |
| rxa01067 | 852 | GB_BA1:U00016 | 42931 | U00016 | *Mycobacterium leprae* cosmid B1937. | *Mycobacterium leprae* | 58,303 | 01 Mar. 1994 |
|  |  | GB_BA1:SYCGROESL | 3256 | D12677 | *Synechocystis* sp. groES and groEL genes. | *Synechocystis* sp. | 34,593 | 3 Feb. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01114 | 1347 | GB_BA1:D90905 | 139467 | D90905 | Synechocystis sp. PCC6803 complete genome, 7/27, 781449-920915 | Synechocystis sp | 34,593 | 7 Feb. 1999 |
|  |  | GB_BA1:PSEFAOAB | 3480 | D10390 | P. fragi faoA and faoB genes, complete cds. | Pseudomonas fragi | 51,919 | 2 Feb. 1999 |
|  |  | GB_BA1:AB014757 | 6057 | AB014757 | Pseudomonas sp. 61-3 genes for PhbR, acetoacetyl-CoA reductase, beta-ketothiolase and PHB synthase, complete cds. | Pseudomonas sp. 61-3 | 50,573 | 26 Dec. 1998 |
|  |  | GB_BA1:SC8D9 | 38681 | AL035569 | Streptomyces coelicolor cosmid 8D9. | Streptomyces coelicolor | 42,200 | 26 Feb. 1999 |
| rxa01136 | 555 | GB_EST11:AA244557 | 379 | AA244557 | mx07a01.r1 Soares mouse NML Mus musculus cDNA clone IMAGE:679464 5', mRNA sequence. | Mus musculus | 39,050 | 10 Mar. 1997 |
|  |  | GB_EST14:AA407673 | 306 | AA407673 | EST01834 Mouse 7.5 dpc embryo ectoplacental cone cDNA library Mus musculus cDNA clone C0014F023, mRNA sequence. | Mus musculus | 38,562 | 26 Aug. 1998 |
|  |  | GB_EST26:A1390328 | 604 | A1390328 | mx07a01.yl Soares mouse NML Mus musculus cDNA clone IMAGE:679464 5', mRNA sequence. | Mus musculus | 33,136 | 2 Feb. 1999 |
| rxa01138 | 540 | GB_OV:XLXINT1 | 1278 | X13138 | Xenopus laevis int-1 mRNA for int-1 protein. | Xenopus laevis | 40,038 | 31 Mar. 1995 |
|  |  | GB_PR4:AC006054 | 143738 | AC006054 | Homo sapiens Xq28 BAC RPCI11-382P7 (Roswell Park Cancer Institute Human BAC Library) complete sequence. | Homo sapiens | 37,996 | 1 Apr. 1999 |
|  |  | GB_PR4:AC006054 | 143738 | AC006054 | Homo sapiens Xq28 BAC RPCI11-382P7 (Roswell Park Cancer Institute Human BAC Library) complete sequence. | Homo sapiens | 36,053 | 1 Apr. 1999 |
| rxa01172 | 1578 | GB_BA1:SCE39 | 23550 | AL049573 | Streptomyces coelicolor cosmid E39. | Streptomyces coelicolor | 62,357 | 31 Mar. 1999 |
|  |  | GB_BA1:MSU50335 | 5193 | U50335 | Mycobacterium smegmatis phage resistance (mpr) gene, complete cds. | Mycobacterium smegmatis | 37,853 | 1 Feb. 1997 |
| rxa01191 | 1713 | GB_BA1:BACTHRTRNA | 15467 | D84213 | Bacillus subtilis genome, tml-feuABC region. | Bacillus subtilis | 53,807 | 6 Feb. 1999 |
|  |  | GB_PR2:HS1191B2 | 60828 | AI022237 | Human DNA sequence from clone 1191B2 on chromosome 22q13.2–13.3. Contains part of the BIK (NBK, BP4, BIP1) gene for BCL2-interacting killer (apoptosis-inducing), a 40S Ribosomal Protein S25 pseudogene and part of an alternatively spliced novel Acyl Transferase gene similar to C. elegans C50D2.7. Contains ESTs, STSs, GSSs, two putative CPG islands and genomic marker D22S1151, complete sequence. | Homo sapiens | 38,366 | 23 Nov. 1999 |
|  |  | GB_PR2:HS1191B2 | 60828 | AI022237 | Human DNA sequence from clone 1191B2 on chromosome 22q13.2–13.3. Contains part of the BIK (NBK, BP4, BIP1) gene for BCL2-interacting killer (apoptosis-inducing), a 40S Ribosomal Protein S25 pseudogene and part of an alternatively spliced novel Acyl Transferase gene similar to C. elegans C50D2.7. Contains ESTs, STSs, GSSs, two putative CPG islands and genomic marker D22S1151, complete sequence. | Homo sapiens | 39,595 | 23 Nov. 1999 |
| rxa01205 | 554 | GB_BA1:MTCY373 | 35516 | Z73419 | Mycobacterium tuberculosis H37Rv complete genome; segment 57/162. | Mycobacterium tuberculosis | 57,762 | 17 Jun. 199B |
|  |  | GB_PL1:ATY12776 | 38483 | Y12776 | Arabidopsis thaliana DNA, 40 kb surrounding ACS1 locus. | Arabidopsis thaliana | 32,971 | 7 Sep. 1998 |
|  |  | GB_PL2:ATT6K21 | 99643 | AL021889 | Arabidopsis thaliana DNA chromosome 4, BAC clone T6K21 (ESSA project). | Arabidopsis thaliana | 35,273 | 16 Aug. 1999 |
| rxa01212 | 1047 | GB_BA2:SCD25 | 41622 | AL118514 | Streptomyces coelicolor cosmid D25. | Streptomyces coelicolor A3(2) | 39,654 | 21 Sep. 1999 |
|  |  | GB_BA1:SLGLYUB | 2576 | X65556 | S. lividans tRNA-GlyU beta gene. | Streptomyces lividans | 54,493 | 20 Dec. 1993 |
|  |  | GB_BA1:SCH10 | 39524 | AL049754 | Streptomyces coelicolor cosmid H10. | Streptomyces coelicolor | 44,638 | 04 May 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01219 | 1005 | GB_PAT:A68024 | 520 | A68024 | Sequence 19 from Patent WO 9743409. | unidentified | 42,553 | 05 May 1999 |
|  |  | GB_PAT:A68025 | 193 | A68025 | Sequence 20 from Patent WO 9743409. | unidentified | 43,229 | 05 May 1999 |
|  |  | GB_PAT:A68027 | 193 | A68027 | Sequence 22 from Patent WO 9743409. | unidentified | 38,342 | 05 May 1999 |
| rxa01220 | 1200 | GB_PR3:HS512B11 | 64356 | AL031058 | Human DNA sequence from clone 512B11 on chromosome 6p24–25. Contains the Desmoplakin I (DPI) gene, ESTs, STSs and GSSs, complete sequence. | Homo sapiens | 35,478 | 23 Nov. 1999 |
|  |  | GB_EST6:N99239 | 424 | N99239 | zb76h11.s1 Soares_senescent_fibroblasts_NbHSF Homo sapiens cDNA clone IMAGE:309573 3', mRNA sequence. | Homo sapiens | 39,623 | 20 Aug. 196 |
|  |  | GB_EST16:M554268 | 400 | AA554268 | nk36c09.s1 NCI_CGAP_GC2 Homo sapiens cDNA clone IMAGE:1015600 3' similar to gb:X01677 GLYCERALDEHYDE 3-PHOSPHATE DEHYDROGENASE, LIVER (HUMAN); mRNA sequence. | Homo sapiens | 36,111 | 8 Sep. 1997 |
| rxa01221 | 849 | GB_PR4:AF179633 | 96371 | AF179633 | Homo sapiens chromosome 16 map 16q23.3–q24.1 sequence. | Homo sapiens | 40,199 | 5 Sep. 1999 |
|  |  | GB_VI:EHVU20824 | 184427 | U20824 | Equine herpesvirus 2, complete genome. | Equine herpesvirus 2 | 37,001 | 2 Feb. 1996 |
|  |  | GB_BA2:AE000407 | 10601 | AE000407 | Escherichia coli K-12 MG1655 section 297 of 400 of the complete genome. | Escherichia coli | 39,471 | 12 Nov. 1998 |
| rxa01222 | 822 | GB_PAT:AR068625 | 28804 | AR068625 | Sequence 1 from U.S. Pat. No. 5854034. | Unknown. | 40,574 | 29 Sep. 1999 |
|  |  | GB_BA2:SSU51197 | 28804 | U51197 | Sphingomonas 588 sphingan polysaccharide synthesis (spsG), (spsS), (spsR), glycosyl transferase (spsQ), (spsI), glycosyl transferase (spsK), glycosyl transferase (spsL), (spsJ), (spsF), (spsD), (spsC), (spsE), Urf 32, Urf 26, ATP-binding cassette transporter (atrD), ATP-binding cassette transporter (atrB), glucosyl-isoprenylphosphate transferase (spsB), glucose-1-phosphate thymidylyltransferase (rhsA), dTDP-6-deoxy-D-glucose-3,5-epimerase (rhsC) dTDP-D-glucose-4,6-dehydratase (rhsB), dTDP-6-deoxy-L-mannose-dehydrogenase (rhsD), Urf 31, and Urf 34 genes, complete cds. | Sphingomonas sp. S88 | 40,574 | 16 May 1996 |
| rxa01260 | 1305 | GB_IN1:BBU44918 | 2791 | U44918 | Babesia bovis ATP-binding protein (babc) mRNA, complete cds. | Babesia bovis | 39,228 | 9 Aug. 197 |
|  |  | GB_BA1:CGLPD | 1800 | Y16642 | Corynebacterium glutamicum lpd gene, complete CDS. | Corynebacterium glutamicum | 99,923 | 1 Feb. 1999 |
|  |  | GB_BA1:MTV038 | 16094 | AL021933 | Mycobacterium tuberculosis H37Rv complete genome; segment 24/162. | Mycobacterium tuberculosis | 59,056 | 17 Jun. 1998 |
|  |  | GB_PR3:AC005618 | 176714 | AC005618 | Homo sapiens chromosome 5, BAC clone 249h5 (LBNL H149), complete sequence. | Homo sapiens | 36,270 | 5 Sep. 1998 |
| rxa01261 | 294 | GB_BA1:CGLPD | 1800 | Y16642 | Corynebacterium glutamicum lpd gene, complete CDS. | Corynebacterium glutamicum | 100,000 | 1 Feb. 1999 |
|  |  | GB_HTG4:AC010045 | 164829 | AC010045 | Drosophila melanogaster chromosome 3L/75A1 clone RPCI98-17C17, *SEQUENCING IN PROGRESS*, 50 unordered pieces. | Drosophila melanogaster | 50,512 | 16 Oct. 1999 |
| rxa01269 | 564 | GB_HTG4:AC010045 | 164829 | AC010045 | Drosophila melanogaster chromosome 3L/75A1 clone RPCI98-17C17, *SEQUENCING IN PROGRESS*, 50 unordered pieces. | Drosophila melanogaster | 50,512 | 16 Oct. 1999 |
|  |  | GB_BA2:AF125164 | 26443 | AF125164 | Bacteroides fragilis 638R polysaccharide B (PS B2) biosynthesis locus, complete sequence; and unknown genes. | Bacteroides fragilis | 56,071 | 01 Dec. 1999 |
|  |  | GB_BA1:AB002668 | 24907 | AB002668 | Actinobacillus actinomycetemcomitans DNA for glycosyltransferase, lytic transglycosylase, dTDP4-rhamnose reductase, complete cds. | Actinobacillus actinomycetemcomitans | 46,679 | 21 Feb. 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01291 | 1056 | GB_BA1:AB010415 | 23112 | AB010415 | Actinobacillus actinomycetemcomitans gene cluster for 6-deoxy-L-talan synthesis, complete cds. | Actinobacillus actinomycetemcomitans | 46,679 | 13 Feb. 1999 |
| | | GB_STS:AU027820 | 238 | AU027820 | Rattus norvegicus, OTSUKA clone, OT78.02/918807, microsatellite sequence, sequence tagged site. | Rattus norvegicus | 34,874 | 02 Mar. 1999 |
| | | GB_STS:AU027820 | 238 | AU027820 | Rattus norvegicus, OTSUKA clone, OT78.02/918807, microsatellite sequence, sequence tagged site. | Rattus norvegicus | 34,874 | 02 Mar. 1999 |
| | | GB_HTG3:AC006445 | 174547 | AC006445 | Homo sapiens chromosome 4, *SEQUENCING IN PROGRESS*, 7 unordered pieces. | Homo sapiens | 34,812 | 15 Sep. 1999 |
| rxa01292 | 1308 | GB_BA1:BSUB0017 | 217420 | Z99120 | Bacillus subtilis complete genome (section 17 of 21): from 3197001 to 3414420. | Bacillus subtilis | 37,802 | 26 Nov. 1997 |
| | | GB_HTG3:AC010580 | 121119 | AC010580 | Drosophila melanogaster chromosome 3 clone BACR48J06 (D1102) RPCI-98 48.J.6 map 96F—96F strain y; cn bw sp. *SEQUENCING IN PROGRESS*, 71 unordered pieces. | Drosophila melanogaster | 35,637 | 01 Oct. 1999 |
| | | GB_HTG3:AC010580 | 121119 | AC010580 | Drosophila melanogaster chromosome 3 clone BACR48J06 (D1102) RPCI-98 48.J.6 map 96F—96F strain y; cn bw sp. *SEQUENCING IN PROGRESS*, 71 unordered pieces. | Drosophila melanogaster | 35,637 | 01 Oct. 1999 |
| rxa01293 | 450 | GB_GSS8:AQ001809 | 705 | AQ001809 | CIT-HSP-2290D17.TF CIT-HSP Homo sapiens genomic clone 2290D17, genomic survey sequence. | Homo sapiens | 42,021 | 26 Jun. 1998 |
| | | GB_GSS8:AQ001809 | 705 | AQ001809 | CIT-HSP-2290D17.TF CIT-HSP Homo sapiens genomic clone 2290D17, genomic survey sequence. | Homo sapiens | 40,323 | 26 Jun. 1998 |
| rxa01339 | 1111 | GB_PL1:MGU60290 | 4614 | U60290 | Magnaporthe grisea nitrogen regulatory protein (NUT1) gene, complete cds. | Magnaporthe grisea | 38,707 | 3 Jul. 1996 |
| | | GB_HTG3:AC011371 | 189187 | AC011371 | Homo sapiens chromosome 5 clone CIT978SKB_107C20 *SEQUENCING IN PROGRESS*, 31 unordered pieces. | Homo sapiens | 39,741 | 06 Oct. 1999 |
| | | GB_HTG3:AC011371 | 189187 | AC011371 | Homo sapiens chromosome 5 clone CIT978SKB_107C20 *SEQUENCING IN PROGRESS*, 31 unordered pieces. | Homo sapiens | 39,741 | 06 Oct. 1999 |
| rxa01382 | 1192 | GB_HTG4:AC009892 | 138122 | AC009892 | Homo sapiens chromosome 19 clone CIT978SKB_83J4 *SEQUENCING IN PROGRESS*, 6 ordered pieces. | Homo sapiens | 40,154 | 31 Oct. 1999 |
| | | GB_HTG4:AC009892 | 138122 | AC009892 | Homo sapiens chromosome 19 clone CIT978SKB_83J4 *SEQUENCING IN PROGRESS*, 6 ordered pieces. | Homo sapiens | 40,154 | 31 Oct. 1999 |
| rxa01399 | 1142 | GB_PR3:AC002416 | 128915 | AC002416 | Human Chromosome X, complete sequence. | Homo sapiens | 37,521 | 29 Jan. 1998 |
| | | GB_EST9:AA096601 | 524 | AA096601 | mo03b09.r1 Stratagene mouse lung 937302 Mus musculus cDNA clone IMAGE:552473 5' similar to gb:L06505 60S RIBOSOMAL PROTEIN L12 (HUMAN); gb:L04280 | Mus musculus | 40,525 | 15 Feb. 1997 |
| | | GB_EST37:AI982114 | 626 | AI982114 | Mus musculus ribosomal protein (MOUSE); mRNA sequence. pat.pk0074.e9.f chicken activated T cell cDNA Gallus gallus cDNA clone pat.pk0074.e9.f 5' similar to H-ATPase B subunit, mRNA sequence. | Gallus gallus | 37,785 | 15 Sep. 1999 |
| | | GB_OV:GGU20766 | 1645 | U20766 | Gallus gallus vacuolar H+-ATPase B subunit gene, complete cds. | Gallus gallus | 38,244 | 07 Dec. 1995 |
| rxa01420 | 1065 | GB_HTG2:AC005690 | 193424 | AC005690 | Homo sapiens chromosome 4, *SEQUENCING IN PROGRESS*, 7 unordered pieces. | Homo sapiens | 37,464 | 11 Apr. 1999 |
| | | GB_HTG2:AC005690 | 193424 | AC005690 | Homo sapiens chromosome 4, *SEQUENCING IN PROGRESS*, 7 unordered pieces. | Homo sapiens | 37,464 | 11 Apr. 1999 |
| | | GB_HTG2:AC006637 | 22092 | AC006637 | Caenorhabditis elegans clone F41B4, *SEQUENCING IN PROGRESS*, 1 unordered pieces. | Caenorhabditis elegans | 37,488 | 23 Feb. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa01467 | 414 | GB_HTG1:CEY102G3_21 | 10000 | AL020985 | Caenorhabditis elegans chromosome V clone Y102G3, ***SEQUENCING IN | Caenorhabditis elegans | 35,437 | 3 Dec. 1998 |
| | | GB_HTG1:CEY102G3_21 | 10000 | AL020985 | Caenorhabditis elegans chromosome V clone Y102G3, ***SEQUENCING IN | Caenorhabditis elegans | 35,437 | 3 Dec. 1998 |
| | | GB_HTG1:CEY113G7_41 | 10000 | AL031113 | Caenorhabditis elegans chromosome V clone Y113G7, ***SEQUENCING IN | Caenorhabditis elegans | 35,437 | 12 Jan. 1999 |
| rxa01576 | 882 | GB_BA2:AF030975 | 2511 | AF030975 | Aeromonas salmonicida chaperonin GroES and chaperonin GroEL genes, complete cds. | Aeromonas salmonicida | 41,516 | 2 Apr. 1998 |
| | | GB_BA2:AF030975 | 2511 | AF030975 | Aeromonas salmonicida chaperonin GroES and chaperonin GroEL genes, complete cds. | Aeromonas salmonicida | 38,171 | 2 Apr. 1998 |
| | | GB_EST22:AI068560 | 965 | AI068560 | mgae0003aC11f Magnaporthe grisea Appressorium Stage cDNA Library Pyricularia grisea cDNA clone mgae0003aC11f 5', mRNA sequence. | Pyricularia grisea | 40,073 | 09 Dec. 1999 |
| rxa01580 | 840 | GB_GSS14:AQ554460 | 681 | AQ554460 | RPCI-11419F2.TV RPCI-11 Homo sapiens genomic clone RPCI-11-419F2, genomic survey sequence. | Homo sapiens | 36,522 | 28 May 1999 |
| | | GB_IN2:AC005449 | 85518 | AC005449 | Drosophila melanogaster, chromosome 2R, region 44C4-44C5, P1 clone DS06765, complete sequence. | Drosophila melanogaster | 36,609 | 23 Dec. 1998 |
| | | GB_IN2:AC005449 | 85518 | AC005449 | Drosophila melanogaster, chromosome 2R, region 44C4-44C5, P1 clone DS06765, complete sequence. | Drosophila melanogaster | 33,612 | 23 Dec. 1998 |
| rxa01584 | | | | | | | | |
| rxa01604 | 771 | GB_HTG3:AC011352 | 160167 | AC011352 | Homo sapiens chromosome 5 clone CIT-HSPC_327F10, *SEQUENCING IN PROGRESS*, 15 unordered pieces. | Homo sapiens | 33,688 | 06 Oct. 1999 |
| | | GB_HTG3:AC011352 | 160167 | AC011352 | Homo sapiens chromosome 5 clone CIT-HSPC_327F10, *SEQUENCING IN PROGRESS*, 15 unordered pieces. | Homo sapiens | 33,688 | 06 Oct. 1999 |
| | | GB_HTG3:AC011402 | 168868 | AC011402 | Homo sapiens chromosome 5 clone CIT978SKB_38B5 *SEQUENCING IN PROGRESS*, 7 unordered pieces. | Homo sapiens | 33,688 | 06 Oct. 1999 |
| rxa01614 | 1146 | GB_BA1:CGA224946 | 2408 | AJ224946 | Corynebacterium glutamicum DNA for L-Malate:quinone oxidoreductase. | Corynebacterium glutamicum | 42,284 | 11 Aug. 1998 |
| | | GB_EST17:AA608825 | 439 | AA608825 | af03g07.s1 Soares_testis_NHT Homo sapiens cDNA clone IMAGE:1030620 3' similar to TR:G976083 G976083 HISTONE H2A RELATED;, mRNA sequence. | Homo sapiens | 40,092 | 02 Mar. 1998 |
| | | GB_PR4:AC005377 | 102311 | AC005377 | Homo sapiens PAC clone DJ1136G02 from 7q32-q34, complete sequence. | Homo sapiens | 37,811 | 28 Apr. 1999 |
| rxa01629 | 1635 | GB_BA1:CGPROPGEN | 2936 | Y12537 | C. glutamicum proP gene. | Corynebacterium glutamicum | 100,000 | 17 Nov. 1998 |
| | | GB_BA1:CGPROPGEN | 2936 | Y12537 | C. glutamicum proP gene. | Corynebacterium glutamicum | 100,000 | 17 Nov. 1998 |
| | | GB_PR4:AF191071 | 88481 | AF191071 | Homo sapiens chromosome 8 clone BAC 388D06, complete sequence. | Homo sapiens | 35,612 | 11 Oct. 1999 |
| rxa01644 | 1401 | GB_BA1:MSGB577COS | 37770 | L01263 | M. leprae genomic dna sequence, cosmid b577. | Mycobacterium leprae | 55,604 | 14 Jun. 1996 |
| | | GB_BA1:MLCB2407 | 35615 | AL023596 | Mycobacterium leprae cosmid B2407. | Mycobacterium leprae | 36,416 | 27 Aug. 1999 |
| | | GB_BA1:MTV025 | 121125 | AL022121 | Mycobacterium tuberculosis H37Rv complete genome; segment 155/162. | Mycobacterium tuberculosis | 55,844 | 24 Jun. 1999 |
| rxa01667 | 1329 | GB_BA1:CGU43536 | 3464 | U43536 | Corynebacterium glutamicum heat shock, ATP-binding protein (clpB) gene, complete cds. | Corynebacterium glutamicum | 100,000 | 13 Mar. 1997 |
| | | GB_HTG4:AC009841 | 164434 | AC009841 | Drosophila melanogaster chromosome 3L/77E1 clone RPCI98-13F11, *SEQUENCING IN PROGRESS*, 70 unordered pieces. | Drosophila melanogaster | 33,205 | 16 Oct. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_HTG4:AC009841 | 164434 | AC009841 | *Drosophila melanogaster* chromosome 3L/77E1 clone RPCI98-13F11, *SEQUENCING IN PROGRESS*, 70 unordered pieces. | *Drosophila melanogaster* | 33,205 | 16 Oct. 1999 |
| rxa01722 | 1848 | GB_GSS1:FR0022586 | 522 | AL015452 | *F. rubripes* GSS sequence, clone 077P23aB10, genomic survey sequence. | *Fugu rubripes* | 40,192 | 10 Dec. 1997 |
| | | GB_GSS1:FR0022584 | 485 | AL015450 | *F. rubripes* GSS sequence, clone 077P23aB11, genomic survey sequence. | *Fugu rubripes* | 35,876 | 10 Dec. 1997 |
| | | GB_IN1:CET26H2 | 37569 | Z82055 | *Caenorhabditis elegans* cosmid T26H2, complete sequence. | *Caenorhabditis elegans* | 34,759 | 19 Nov. 1999 |
| rxa01727 | 1401 | GB_BA2:CORCSLYS | 2821 | M89931 | *Corynebacterium glutamicum* beta C-S lyase (aecD) and branched-chain amino acid uptake carrier (bmQ) genes, complete cds, and hypothetical protein Yhbw (yhbw) gene, partial cds. | *Corynebacterium glutamicum* | 99,929 | 4 Jun. 1998 |
| | | GB_HTG6:AC011037 | 167849 | AC011037 | *Homo sapiens* clone RP11-7F18, WORKING DRAFT SEQUENCE, 19 unordered pieces. | *Homo sapiens* | 36,903 | 30 Nov. 1999 |
| | | GB_HTG6:AC011037 | 167849 | AC011037 | *Homo sapiens* clone RP11-7F18, WORKING DRAFT SEQUENCE, 19 unordered pieces. | *Homo sapiens* | 35,642 | 30 Nov. 1999 |
| rxa01737 | 1182 | GB_BA1:SCGD3 | 33779 | AL096822 | *Streptomyces coelicolor* cosmid GD3. | *Streptomyces coelicolor* | 38,054 | 8 Jul. 1999 |
| | | GB_HTG1:CNS01DSB | 222193 | AL121768 | *Homo sapiens* chromosome 14 clone R-976B16, *SEQUENCING IN PROGRESS*, in ordered pieces. | *Homo sapiens* | 35,147 | 05 Oct. 1999 |
| | | GB_HTG1:CNS01DSB | 222193 | AL121768 | *Homo sapiens* chromosome 14 clone R-976B16, *SEQUENCING IN PROGRESS*, in ordered pieces. | *Homo sapiens* | 35,147 | 05 Oct. 1999 |
| rxa01762 | 1659 | GB_BA1:MTC128 | 36300 | Z97050 | *Mycobacterium tuberculosis* H37Rv complete genome; segment 10/162. | *Mycobacterium tuberculosis* | 49,574 | 23 Jun. 1998 |
| | | GB_BA1:SC6G10 | 36734 | AL049497 | *Streptomyces coelicolor* cosmid 6G10. | *Streptomyces coelicolor* | 44,049 | 24 Mar. 1999 |
| | | GB_BA1:SCE29 | 26477 | AL035707 | *Streptomyces coelicolor* cosmid E29. | *Streptomyces coelicolor* | 40,246 | 12 Mar. 1999 |
| rxa01764 | 1056 | GB_PL2:SPAC343 | 42947 | AL109739 | *S. pombe* chromosome I cosmid c343. | *Schizosaccharomyces pombe* | 37,084 | 6 Sep. 1999 |
| | | GB_PL2:SPAC343 | 42947 | AL109739 | *S. pombe* chromosome I cosmid c343. | *Schizosaccharomyces pombe* | 34,890 | 6 Sep. 1999 |
| rxa01801 | 1140 | GB_EST38:AW066306 | 334 | AW066306 | 687009D03.y1 687 - Early embryo from Delaware Zea mays cDNA, mRNA sequence. | *Zea mays* | 46,108 | 12 Oct. 1999 |
| | | GB_GSS13:AQ484750 | 375 | AQ484750 | RPCI-11-248N4.TV RPCI-11 *Homo sapiens* genomic clone RPCI-11-248N4, genomic survey sequence. | *Homo sapiens* | 32,000 | 24 Apr. 1999 |
| | | GB_GSS13:AQ489971 | 252 | AQ489971 | RPCI-11-247N23.TVRPCI-11 *Homo sapiens* genomic clone RPCI-11-247N23, genomic survey sequence. | *Homo sapiens* | 36,111 | 24 Apr. 1999 |
| rxa01823 | 900 | GB_BA1:SCI51 | 40745 | AL109173 | *Streptomyces coelicolor* cosmid 151. | *Streptomyces coelicolor* A3(2) | 35,779 | 16 Aug. 1999 |
| | | GB_BA1:ECU82598 | 136742 | U82598 | *Escherichia coli* genomic sequence of minutes 9 to 12. | *Escherichia coli* | 39,211 | 15 Jan. 1997 |
| | | GB_BA1:BSUB0018 | 209510 | Z99121 | *Bacillus subtilis* complete genome (section 18 of 21): from 3399551 to 3609060. | *Bacillus subtilis* | 36,999 | 26 Nov. 1997 |
| rxa01853 | 675 | GB_BA1:MTCY227 | 35946 | Z77724 | *Mycobacterium tuberculosis* H37Rv complete genome; segment 114/162. | *Mycobacterium tuberculosis* | 37,612 | 17 Jun. 1998 |
| | | GB_HTG3:AC010189 | 265962 | AC010189 | *Homo sapiens* clone RPCI11-296K13, *SEQUENCING IN PROGRESS*, 80 unordered pieces. | *Homo sapiens* | 39,006 | 16 Sep. 1999 |
| | | GB_HTG3:AC010189 | 265962 | AC010189 | *Homo sapiens* clone RPCI11-296K13, *SEQUENCING IN PROGRESS*, 80 unordered pieces. | *Homo sapiens* | 39,006 | 16 Sep. 1999 |
| rxa01881 | 558 | GB_HTG4:AC011117 | 148447 | AC011117 | *Homo sapiens* chromosome 4 clone 173_C_09 map 4, *SEQUENCING IN PROGRESS*, 10 ordered pieces. | *Homo sapiens* | 39,130 | 14 Oct. 1999 |
| | | GB_HTG4:AC011117 | 148447 | AC011117 | *Homo sapiens* chromosome 4 clone 173_C_09 map 4, *SEQUENCING IN PROGRESS*, 10 ordered pieces. | *Homo sapiens* | 39,130 | 14 Oct. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_BA1:MTCY2B12 | 20431 | Z81011 | *Mycobacterium tuberculosis* H37Rv complete genome; segment 61/162. | *Mycobacterium tuberculosis* | 37,893 | 18 Jun. 1998 |
| rxa01894 | 978 | GB_BA1:MTCY274 | 39991 | Z74024 | *Mycobacterium tuberculosis* H37Rv complete genome; segment 61/162. | *Mycobacterium tuberculosis* | 37,229 | 19 Jun. 1998 |
| | | GB_IN1:CELF46H5 | 38886 | U41543 | *Caenorhabditis elegans* cosmid F46H5. | *Caenorhabditis elegans* | 38,525 | 29 Nov. 1996 |
| | | GB_HTG3:AC009204 | 115633 | AC009204 | *Drosophila melanogaster* chromosome 2 clone BACR03E19 (D1033) RPCI-98 03.E.19 map 36E-37C strain y; cn bwsp, *SEQUENCING IN PROGRESS*, 94 unordered pieces. | *Drosophila melanogaster* | 31,579 | 18 Aug. 1999 |
| rxa01897 | 666 | GB_HTG1:CEY48B6 | 293827 | AL021151 | *Caenorhabditis elegans* chromosome II clone Y48B6, *SEQUENCING IN PROGRESS*, in unordered pieces. | *Caenorhabditis elegans* | 34,703 | 1 Apr. 1999 |
| | | GB_HTG1:CEY48B6 | 293827 | AL021151 | *Caenorhabditis elegans* chromosome II clone Y48B6, *SEQUENCING IN PROGRESS*, in unordered pieces. | *Caenorhabditis elegans* | 34,703 | 1 Apr. 1999 |
| | | GB_HTG1:CEY53F4_2 | 110000 | Z92860 | *Caenorhabditis elegans* chromosome II clone Y53F4, *SEQUENCING IN PROGRESS*, in unordered pieces. | *Caenorhabditis elegans* | 33,333 | 15 Oct. 1999 |
| rxa01946 | 1298 | GB_BA1:MTV007 | 32806 | AL021184 | *Mycobacterium tuberculosis* H37Rv complete genome; segment 64/162. | *Mycobacterium tuberculosis* | 65,560 | 17 Jun. 1998 |
| | | GB_BA1:SC5F2A | 40105 | AL049587 | *Streptomyces coelicolor* cosmid 5F2A. | *Streptomyces coelicolor* | 50,648 | 24 May 1999 |
| | | GB_BA1:SCARD1GN | 2321 | X84374 | *S. capreolus* ard1 gene. | *Streptomyces capreolus* | 44,973 | 23 Aug. 1995 |
| rxa01980 | 756 | GB_PL2:AC008262 | 99698 | AC008262 | Genomic sequence for *Arabidopsis thaliana* BAC F4N2 from chromosome I, complete sequence. | *Arabidopsis thaliana* | 35,310 | 21 Aug. 1999 |
| | | GB_PL1:AB013388 | 73428 | AB013388 | *Arabidopsis thaliana* genomic DNA, chromosome 5, TAC clone: K19E1, complete sequence. | *Arabidopsis thaliana* | 35,505 | 20 Nov. 1999 |
| | | GB_PL1:AB013388 | 73428 | AB013388 | *Arabidopsis thaliana* genomic DNA, chromosome 5, TAC clone: K19E1, complete sequence. | *Arabidopsis thaliana* | 39,973 | 20 Nov. 1999 |
| rxa01983 | 630 | GB_HTG4:AC006467 | 175695 | AC006467 | *Drosophila melanogaster* chromosome 2 clone BACR03L08 (D532) RPCI-98 03.L.8 map 40A–40C strain y; cn bw sp, *SEQUENCING IN PROGRESS*, 9 unordered pieces. | *Drosophila melanogaster* | 36,672 | 27 Oct. 1999 |
| | | GB_HTG4:AC006467 | 175695 | AC006467 | *Drosophila melanogaster* chromosome 2 clone BACR03L08 (D532) RPCI-98 03.L.8 map 40A–40C strain y; cn bw sp, *SEQUENCING IN PROGRESS*, 9 unordered pieces. | *Drosophila melanogaster* | 36,672 | 27 Oct. 1999 |
| | | GB_HTG4:AC006467 | 175695 | AC006467 | *Drosophila melanogaster* chromosome 2 clone BACR03L08 (D532) RPCI-98 03.L.8 map 40A–40C strain y; cn bw sp, *SEQUENCING IN PROGRESS*, 9 unordered pieces. | *Drosophila melanogaster* | 32,367 | 27 Oct. 1999 |
| rxa02020 | 1111 | GB_BA1:CGDNMROP | 2612 | X85965 | *C. glutamicum* ORF 3 and aroP gene. | *Corynebacterium glutamicum* | 100,000 | 30 Nov. 1997 |
| | | GB_PAT:A58887 | 1612 | A58887 | Sequence 1 from Patent WO 9701637. | unidentified | 100,000 | 06 Mar. 1998 |
| | | GB_BA1:STYCARABA | 4378 | M95047 | *Salmonella typhimurium* transport protein, complete cds, and transfer RNA-Arg. | *Salmonella typhimurium* | 50,547 | 13 Mar. 1996 |
| rxa02029 | 1437 | GB_HTG2:AC003023 | 104768 | AC003023 | *Homo sapiens* chromosome 11 clone pDJ363p2, *SEQUENCING IN PROGRESS*, 22 unordered pieces. | *Homo sapiens* | 35,820 | 21 Oct. 1997 |
| | | GB_HTG2:AC003023 | 104768 | AC003023 | *Homo sapiens* chromosome 11 clone pDJ363p2, *SEQUENCING IN PROGRESS*, 22 unordered pieces. | *Homo sapiens* | 35,820 | 21 Oct. 1997 |
| | | GB_HTG2:HS118B18 | 104729 | AL034344 | *Homo sapiens* chromosome 6 clone RP1-118B18 map p24.1–25.3, *SEQUENCING IN PROGRESS*, in unordered pieces. | *Homo sapiens* | 34,355 | 03 Dec. 1999 |
| rxa02030 | 1509 | GB_PR4:AC007695 | 63247 | AC007695 | *Homo sapiens* 12q24 BAC RPCI11-124N23 (Roswell Park Cancer Institute Human BAC Library) complete sequence. | *Homo sapiens* | 38,681 | 1 Sep. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_PR4:AC006464 | 99908 | AC006464 | *Homo sapiens* BAC clone NH0436C12 from 2, complete sequence. | *Homo sapiens* | 35,445 | 22 Oct. 1999 |
| | | GB_PR4:AC006464 | 99908 | AC006464 | *Homo sapiens* BAC clone NH0436C12 from 2, complete sequence. | *Homo sapiens* | 35,968 | 22 Oct. 1999 |
| rxa02073 | 1653 | GB_BA1:CGGDHA | 2037 | X72855 | *C. glutamicum* GDHA gene. | *Corynebacterium glutamicum* | 39,655 | 24 May 1993 |
| | | GB_BA1:CGGDH | 2037 | X59404 | *Corynebacterium glutamicum*, gdh gen for glutamate dehydrogenase. | *Corynebacterium glutamicum* | 44,444 | 30 Jul. 1999 |
| rxa02074 | | GB_BA2:SC2H4 | 25970 | AL031514 | *Streptomyces coelicolor* cosmid 2H4. | *Streptomyces coelicolor* A3(2) | 38,452 | 19 Oct. 1999 |
| rxa02095 | 1527 | GB_EST18:AA703380 | 471 | AA703380 | zj12b06.s1 Soares_fetal_liver_spleen_1NFLS_S1 *Homo sapiens* cDNA clone IMAGE:450035 3' similar to contains LTR5.t3 LTR5 repetitive element;, mRNA sequence. | *Homo sapiens* | 36,518 | 24 Dec. 1997 |
| | | GB_HTG6:AC009769 | 122911 | AC009769 | *Homo sapiens* chromosome 8 clone RP11-202I12 map 8, LOW-PASS SEQUENCE SAMPLING. | *Homo sapiens* | 35,473 | 07 Dec. 1999 |
| | | GB_EST7:W70175 | 436 | W70175 | zd52c02.r1 Soares_fetal_heart_NbHH19W *Homo sapiens* cDNA clone IMAGE:344258 5' similar to contains LTR5.b2 LTR5 repetitive element;, mRNA sequence. | *Homo sapiens* | 34,174 | 16 Oct. 1996 |
| rxa02099 | 373 | GB_BA1:CAJ10319 | 5368 | AJ010319 | *Corynebacterium glutamicum* amtP, glnB, glnD genes and partial fts Y and spr genes. | *Corynebacterium glutamicum* | 100,000 | 14 May 1999 |
| | | GB_HTG3:AC011509 | 111353 | AC011509 | *Homo sapiens* chromosome 19 clone CITB-H1_2189E23, *SEQUENCING IN PROGRESS*, 35 unordered pieces. | *Homo sapiens* | 33,423 | 07 Oct. 1999 |
| | | GB_HTG3:AC011509 | 111353 | AC011509 | *Homo sapiens* chromosome 19 clone CITB-H1_2189E23, *SEQUENCING IN PROGRESS*, 35 unordered pieces. | *Homo sapiens* | 33,423 | 07 Oct. 1999 |
| rxa02115 | 1197 | GB_HTG5:AC010126 | 175986 | AC010126 | *Homo sapiens* clone GS502B02, *SEQUENCING IN PROGRESS*, 3 unordered pieces. | *Homo sapiens* | 36,717 | 13 Nov. 1999 |
| | | GB_HTG5:AC010126 | 175986 | AC010126 | *Homo sapiens* clone GS502B02, *SEQUENCING IN PROGRESS*, 3 unordered pieces. | *Homo sapiens* | 36,092 | 13 Nov. 1999 |
| | | GB_PR1:HUMHM145 | 2214 | D10925 | Human mRNA for HM145. | *Homo sapiens* | 39,171 | 3 Feb. 1999 |
| rxa02128 | 1818 | GB_BA1:MTCY190 | 34150 | Z70283 | *Mycobacterium tuberculosis* H37Rv complete genome; segment 98/162. | *Mycobacterium tuberculosis* | 38,682 | 17 Jun. 1998 |
| | | GB_BA1:MTCY190 | 34150 | Z70283 | *Mycobacterium tuberculosis* H37Rv complete genome; segment 98/162. | *Mycobacterium tuberculosis* | 35,746 | 17 Jun. 1998 |
| | | GB_GSS10:AQ161109 | 738 | AQ161109 | nbxb0006D03r CUGI Rice BAC Library *Oryza sativa* genomic clone nbxb0006D03r, genomic survey sequence. | *Oryza sativa* | 38,842 | 12 Sep. 1998 |
| rxa02133 | 329 | GB_BA2:MPAE000058 | 28530 | AE000058 | *Mycoplasma pneumoniae* sectin 58 of 63 of the complete genome. | *Mycoplasma pneumoniae* | 32,317 | 18 Nov. 1996 |
| | | GB_HTG4:AC008308 | 151373 | AC008308 | *Drosophila melanogaster* chromosome 3 clone BACR10M16 (D743) RPCI-98 10.M.16 map 93C–93D strain y; cn bw sp, *SEQUENCING IN PROGRESS*, 186 unordered pieces. | *Drosophila melanogaster* | 34,579 | 20 Oct. 1999 |
| | | GB_HTG4:AC008308 | 151373 | AC008308 | *Drosophila melanogaster* chromosome 3 clone BACR10M16 (D743) RPCI-98 10.M.16 map 93C–93D strain y; cn bw sp, *SEQUENCING IN PROGRESS*, 186 unordered pieces. | *Drosophila melanogaster* | 34,579 | 20 Oct. 1999 |
| rxa02150 | 924 | GB_EST37:AW012260 | 358 | AW012260 | um06e09.y1 Sugano mouse kidney mkia *Mus musculus* cDNA clone IMAGE:2182312 5' similar to SW:AMPL_BOVIN P00727 CYTOSOL AMINOPEPTIDASE;, mRNA sequence. | *Mus musculus* | 39,385 | 10 Sep. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02171 | | GB_GSS3:B87734 | 389 | B87734 | RPCI11-30D24.TP RPCI-11 Homo sapiens genomic clone RPCI-11-30D24, genomic survey sequence. | Homo sapiens | 37,629 | 9 Apr. 1999 |
| | 1776 | GB_PR4:AC005042 | 192218 | AC005042 | Homo sapiens clone NH0552E01, complete sequence. | Homo sapiens | 36,901 | 14 Jan. 1999 |
| | | GB_BA2:AF010496 | 189370 | AF010496 | Rhodobacter capsulatus strain SB1003, partial genome. | Rhodobacter capsulatus | 53,714 | 12 May 1998 |
| | | GB_EST24:AI170522 | 367 | AI170522 | EST216450 Normalized rat lung, Bento Soares Rattus sp. cDNA clone RLUCO75 3' end, mRNA sequence. | Rattus sp. | 44,186 | 20 Jan. 1999 |
| rxa02173 | | GB_PL1:PHVDLECA | 1441 | K03288 | P. vulgaris phytohemagglutinin encoding erythroagglutinating phytohemagglutin (PHA-E), complete cds. | Phaseolus vulgaris | 39,103 | 27 Apr. 1993 |
| | 1575 | GB_BA1:CGGLTG | 3013 | X66112 | C. glutamicum gl gene for citrate synthase and ORF. | Corynebacterium glutamicum | 44,118 | 17 Feb. 1995 |
| | | GB_BA1:CGGLTG | 3013 | X66112 | C. glutamicum gl gene for citrate synthase and ORF. | Corynebacterium glutamicum | 36,189 | 17 Feb. 1995 |
| | | GB_BA2:AE000104 | 10146 | AE000104 | Rhizobium sp. NGR234 plasmid pNGR234a, section 41 of 46 of the complete plasmid sequence. | Rhizobium sp. NGR234 | 38,487 | 12 Dec. 1997 |
| rxa02224 | 1920 | GB_BA2:CXU21300 | 8990 | U21300 | Corynebacterium striatum hypothetical protein YbhB gene, partial cds; ABC transporter TetB (tetB), ABC transporter TetA (tetA), transposase, 23S rRNA methyltransferase, and transposase genes, complete cds; and unknown genes. | Corynebacterium striatum | 37,264 | 9 Apr. 1999 |
| | | GB_HTG3:AC009185 | 87184 | AC009185 | Homo sapiens chromosome 5 clone CIT-HSPC_248O19, *SEQUENCING IN PROGRESS*, 2 ordered pieces. | Homo sapiens | 36,459 | 07 Oct. 1999 |
| | | GB_HTG3:AC009185 | 87184 | AC009185 | Homo sapiens chromosome 5 clone CIT-HSPC_248O19, *SEQUENCING IN PROGRESS*, 2 ordered pieces. | Homo sapiens | 36,459 | 07 Oct. 1999 |
| rxa02225 | 905 | GB_BA2:MPAE000058 | 28530 | AE000058 | Mycoplasma pneumoniae section 58 of 63 of the complete genome. | Mycoplasma pneumoniae | 35,498 | 18 Nov. 1996 |
| | | GB_EST26:AI337275 | 618 | AI337275 | tb96h11.x1 NCI_CGAP_Col6 Homo sapiens cDNA clone IMAGE:2062245 3' similar to TR:Q15392 Q15392 ORF, COMPLETE CDS;. mRNA sequence. | Homo sapiens | 35,589 | 18 Mar. 1999 |
| | | GB_EST26:AI337275 | 618 | AI337275 | tb96h11.x1 NCI_CGAP_Col6 Homo sapiens cDNA clone IMAGE:2062245 3' similar to TR:Q15392 Q15392 ORF, COMPLETE CDS;. mRNA sequence. | Homo sapiens | 42,786 | 18 Mar. 1999 |
| rxa02233 | 1410 | GB_BA1:ERWPNLB | 1291 | M65057 | Erwinia carotovora pectin lyase (pnl) gene, complete cds. | Erwinia carotovora | 37,780 | 26 Apr. 1993 |
| | | GB_EST30:AV021947 | 313 | AV021947 | AV021947 Mus musculus 18 day embryo C57BL/6J Mus musculus cDNA clone 1190024M23, mRNA sequence. | Mus musculus | 39,423 | 28 Aug. 1999 |
| | | GB_EST33:AV087117 | 251 | AV087117 | AV087117 Mus musculus tongue C57BL/6J adult Mus musculus cDNA clone 2310028C15, mRNA sequence | Mus musculus | 47,410 | 25 Jun. 1999 |
| rxa02253 | 1050 | GB_EST11:AA250210 | 532 | AA250210 | mx79g10.r1 Soares mouse NML Mus musculus cDNA clone IMAGE:692610 5' similar to TR:E236517 E236517 F44G4.1;. mRNA sequence. | Mus musculus | 36,136 | 12 Mar. 1997 |
| | | GB_EST11:AA250210 | 532 | AA50210 | mx79g10.r1 Soares mouse NML Mus musculus cDNA clone IMAGE:692610 5' similar to TR:E236517 E236517 F44G4.1;. mRNA sequence. | Mus musculus | 36,136 | 12 Mar. 1997 |
| rxa02261 | 1479 | GB_BA1:CGL007732 | 4460 | AJ007732 | Corynebacterium glutamicum 3' ppc gene, secG gene, amt gene, ocd gene and 5' soxA gene. | Corynebacterium glutamicum | 100,000 | 7 Jan. 1999 |
| | | GB_BA1:CGAMTGENE | 2028 | X93513 | C. glutamicum amt gene. | Corynebacterium glutamicum | 100,000 | 29 May 1996 |
| | | GB_BA1:CORPEPC | 4885 | M25819 | C. glutamicum phosphoenolpyruvate carboxylase gene, complete cds. | Corynebacterium glutamicum | 100,000 | 15 Dec. 1995 |
| rxa02268 | 1023 | GB_PL2:AF087130 | 3478 | AF087130 | Neurospora crassa siderophore regulation protein (sre) gene, complete cds. | Neurospora crassa | 39,268 | 22 Oct. 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| | | GB_EST30:AI663709 | 408 | AI663709 | ud47a06.y1 Soares mouse mammary gland NbMMG Mus musculus cDNA clone IMAGE:1449010 5' similar to TR:O75585 O75585 MITOGEN- AND STRESS- ACTIVATED PROTEIN KINASE-2;, mRNA sequence. | Mus musculus | 41,523 | 10 May 1999 |
| rxa02269 | 1095 | GB_RO:AF074714 | 3120 | AF074714 | Mus musculus mitogen- and stress-activated protein kinase-2 (mMSK2) mRNA, complete cds. | Mus musculus | 38,347 | 24 Oct. 1998 |
| | | GB_GSS4:AQ742825 | 847 | AQ742825 | HS_5482_B2_A04_T7A RPCI-11 Human Male BAC Library Homo sapiens genomic clone Plate = 1058 Col = 8 Row = B, genomic survey sequence | Homo sapiens | 37,703 | 16 Jul. 1999 |
| | | GB_HTG3:AC009293 | 162944 | AC009293 | Homo sapiens chromosome 18 clone 53_I_06 map 18, *SEQUENCING IN PROGRESS*, 15 unordered pieces. | Homo sapiens | 37,006 | 13 Aug. 1999 |
| | | GB_HTG3:AC009293 | 162944 | AC009293 | Homo sapiens chromosome 18 clone 53_I_06 map 18, *SEQUENCING IN PROGRESS*, 15 unordered pieces. | Homo sapiens | 37,006 | 13 Aug. 1999 |
| rxa02309 | 1173 | GB_BA1:MTY25D10 | 40838 | Z95558 | Mycobacterium tuberculosis H37Rv complete genome; segment 28/162. | Mycobacterium tuberculosis | 52,344 | 17 Jun. 1998 |
| | | GB_BA1:MSGY224 | 40051 | AD000004 | Mycobacterium tuberculosis sequence from clone y224. | Mycobacterium tuberculosis | 52,344 | 03 Dec. 1996 |
| | | GB_HTG2:AC007163 | 186618 | AC007163 | Homo sapiens clone NH0091M05, *SEQUENCING IN PROGRESS*, 1 unordered pieces. | Homo sapiens | 37,263 | 23 Apr. 1999 |
| rxa02310 | 1386 | GB_BA1:MTY25D10 | 40838 | Z95558 | Mycobacterium tuberculosis H37RV complete genome; segment 28/162. | Mycobacterium tuberculosis | 36,861 | 17 Jun. 1998 |
| | | GB_BA1:MSGY224 | 40051 | AD000004 | Mycobacterium tuberculosis sequence from clone y224. | Mycobacterium tuberculosis | 36,861 | 03 Dec. 1996 |
| | | GB_PR3:HS279N11 | 169998 | Z98255 | Human DNA sequence from PAC 279N11 on chromosome Xq11.2–13.3. | Homo sapiens | 34,516 | 23 Nov. 1999 |
| rxa02321 | 1752 | GB_BA1:AB018531 | 4961 | AB018531 | Corynebacterium glutamicum dtsR1 and dtsR2 genes, complete cds. | Corynebacterium glutamicum | 99,030 | 19 Oct. 1998 |
| | | GB_PAT:E17019 | 4961 | E17019 | Brevibacterium lactofermentum dtsR and dtsR2 genes. | Corynebacterium glutamicum | 98,973 | 28 Jul. 1999 |
| | | GB_BA1:AB018530 | 2855 | AB018530 | Corynebacterium glutamicum dtsR gene, complete cds. | Corynebacterium glutamicum | 99,030 | 19 Oct. 1998 |
| rxa02335 | 1896 | GB_BA1:CGU35023 | 3195 | U35023 | Corynebacterium glutamicum thiosulfate sulfurtransferase (thtR) gene, partial cds, acyl CoA carboxylase (accBC) gene, complete cds. | Corynebacterium glutamicum | 99,947 | 16 Jan. 1997 |
| | | GB_BA1:U00012 | 33312 | U00012 | Mycobacterium leprae cosmid B1308. | Mycobacterium leprae | 40,247 | 30 Jan. 1996 |
| | | GB_BA1:MTCY71 | 42729 | Z92771 | Mycobacterium tuberculosis H37Rv complete genome; segment 141/162. | Mycobacterium tuberculosis | 67,568 | 10 Feb. 1999 |
| rxa02364 | 750 | GB_BA1:AP000006 | 319000 | AP000006 | Pyrococcus horikoshii OT3 genomic DNA, 1166001–1485000 nt position (6/7). | Pyrococcus horikoshii | 35,543 | 8 Feb. 1999 |
| rxa02372 | 2010 | GB_BA1:AP000006 | 319000 | AP000006 | Pyrococcus horikoshii OT3 genomic DNA, 1166001–1485000 nt position (6/7). | Pyrococcus horikoshii | 36,130 | 8 Feb. 1999 |
| | | GB_HTG3:AC011461 | 100974 | AC011461 | Homo sapiens chromosome 19 clone CIT-HSPC_429L19 *SEQUENCING IN PROGRESS*, 4 ordered pieces. | Homo sapiens | 36,138 | 07 Oct. 1999 |
| | | GB_HTG3:AC011461 | 100974 | AC011461 | Homo sapiens chromosome 19 clone CIT-HSPC_429L19 *SEQUENCING IN PROGRESS*, 4 ordered pieces. | Homo sapiens | 36,138 | 07 Oct. 1999 |
| | | GB_EST21:AA992021 | 279 | AA992021 | ot36c01.s1 Soares_testis_NHT Homo sapiens cDNA clone IMAGE:1618848 3', mRNA sequence. | Homo sapiens | 41,219 | 3 Jun. 1998 |
| rxa02397 | 1119 | GB_HTG4:AC009273 | 76175 | AC009273 | Arabidopsis thaliana chromosome 1 clone T1N6, *SEQUENCING IN PROGRESS*, 2 ordered pieces. | Arabidopsis thaliana | 38,566 | 12 Oct. 1999 |
| | | GB_HTG4:AC009273 | 76175 | AC009273 | Arabidopsis thaliana chromosome 1 clone T1N6, *SEQUENCING IN PROGRESS*, 2 ordered pieces. | Arabidopsis thaliana | 38,566 | 12 Oct. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02424 | | GB_BA1:D90826 | 19493 | D90826 | E. coli genomic DNA, Kohara clone #335(40.9–41.3 min.). | Escherichia coli | 39,600 | 21 Mar. 1997 |
| | 723 | GB_EST13:AA334108 | 275 | AA334108 | EST38262 Embryo, 9 week Homo sapiens cDNA 5' end, mRNA sequence. | Homo sapiens | 38,603 | 21 Apr. 1997 |
| | | GB_PR3:AC005224 | 166687 | AC005224 | Homo sapiens chromosome 17, clone hRPK.214_O_1, complete sequence. | Homo sapiens | 36,111 | 14 Aug. 1998 |
| | | GB_PR3:AC005224 | 166687 | AC005224 | Homo sapiens chromosome 17, clone hRPK.214_O_1, complete sequence. | Homo sapiens | 33,427 | 14 Aug. 1998 |
| rxa02426 | 1656 | GB_PAT:A06664 | 1350 | A06664 | B. stearothermophiluslct gene. | Bacillus stearothermophilus | 39,936 | 29 Jul. 1993 |
| | | GB_PAT:A04115 | 1361 | A04115 | B. stearothermophilusrecombinant lct gene. | synthetic construct | 40,042 | 17 Feb. 1997 |
| | | GB_BA1:BACLDHL | 1361 | M14788 | B. stearothermophiluslct gene encoding L-lactate dehydrogenase, complete cds. | Bacillus stearothermophilus | 40,338 | 26 Apr. 1993 |
| rxa02487 | 1827 | GB_BA2:AF007101 | 32870 | AF007101 | Streptomyces hygroscopicus putative pteridine-dependent dioxygenase, PKS modules 1, 2, 3 and 4, and putative regulatory protein genes, complete cds and putative hydroxylase gene, partial cds. | Streptomyces hygroscopicus | 43,298 | 13 Jan. 1998 |
| | | GB_BA1:MTCI364 | 29540 | Z93777 | Mycobacterium tuberculosis H37Rv complete genome; segment 52/162. | Mycobacterium tuberculosis | 44,352 | 17 Jun. 1998 |
| | | GB_BA2:AF119621 | 15986 | AF119621 | Pseudomonas abietaniphila BKME-9 DitI (ditI), dioxygenase DitA oxygenase component small subunit (ditA2), dioxygenase DitA oxygenase component large subunit (ditA1), DitH (ditH), DitG (ditG), DitF (ditF), DitR (ditR), DitE (ditE), DitD (ditD), aromatic diterpenoid extradiol ring-cleavage dioxygenase (ditC), DitB (ditB), and dioxygenase DitA ferredoxin component (ditA3) genes, complete cds; and unknown genes. | Pseudomonas abietaniphila | 43,611 | 28 Apr. 1999 |
| rxa02511 | 780 | GB_PR4:AC002470 | 235395 | AC002470 | Homo sapiens Chromosome 22q11.2BAC Clone b135h6 In BCRL2-GGT Region, complete sequence. | Homo sapiens | 37,971 | 30 Nov. 1999 |
| | | GB_PR4:AC002472 | 147100 | AC002472 | Homo sapiens Chromosome 22q11.2PAC Clone p_n5 In BCRL2-GGT Region, complete sequence. | Homo sapiens | 38,239 | 13 Sep. 1999 |
| | | GB_EST34:AI806938 | 118 | AI806938 | wf24b07.x1 Soares_NFL_T_GBC_S1 Homo sapiens cDNA clone IMAGE:2356501 3' similar to SW:PLZF_HUMAN Q05516 ZINC FINGER PROTEIN PLZF; mRNA sequence. | Homo sapiens | 38,983 | 7 Jul. 1999 |
| rxa02512 | 1086 | GB_BA1:MTCY1A10 | 25949 | Z95387 | Mycobacterium tuberculosis H37Rv complete genome; segment 117/162. | Mycobacterium tuberculosis | 37,407 | 17 Jun. 1998 |
| | | GB_BA1:MLCL581 | 36225 | Z96801 | Mycobacterium leprae cosmid L581. | Mycobacterium leprae | 43,193 | 24 Jun. 1997 |
| | | GB_OV:GGU43396 | 2738 | U43396 | Gallus gallus tropomyosin receptor kinase A (ctrkA) mRNA, complete cds. | Gallus gallus | 38,789 | 18 Jan. 1996 |
| rxa02527 | 1452 | GB_BA2:AF008220 | 220060 | AF008220 | Bacillus subtilis rrnB-dnaB genomic region. | Bacillus subtilis | 37,395 | 4 Feb. 1998 |
| | | GB_BA2:AF008220 | 220060 | AF008220 | Bacillus subtilis rrnB-dnaB genomic region. | Bacillus subtilis | 36,218 | 4 Feb. 1998 |
| | | GB_HTG2:AC005861 | 112369 | AC005861 | Arabidopsis thaliana clone F23B24, *SEQUENCING IN PROGRESS*, 6 unordered pieces. | Arabidopsis thaliana | 38,407 | 29 Apr. 1999 |
| rxa02547 | 2262 | GB_PL1:AB006530 | 7344 | AB006530 | Citrullus lanatus Sat gene for serine acetyltransferase, complete cds and 5'-flanking region. | Citrullus lanatus | 35,449 | 20 Aug. 1997 |
| | | GB_PL1:CNASA | 5729 | D85624 | Citrullus vulgaris serine acetyltransferase (Sat) DNA, complete cds. | Citrullus lanatus | 35,449 | 6 Feb. 1999 |
| | | GB_PL1:AB006530 | 7344 | AB006530 | Citrullus lanatus Sat gene for serine acetyltransferase, complete cds and 5'-flanking region. | Citrullus lanatus | 34,646 | 20 Aug. 1997 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02566 | 1332 | GB_EST32:AI727189 | 619 | AI727189 | BNLGHi7498 Six-day Cotton fiber Gossypium hirsutum cDNA 5' similar to (AB020715) KIAA0908 protein [Homo sapiens], mRNA sequence. | Gossypium hirsutum | 35,099 | 11 Jun. 1999 |
|  |  | GB_BA1:CGPUTP | 3791 | Y09163 | C. glutamicum putP gene. | Corynebacterium glutamicum | 38,562 | 8 Sep. 1997 |
|  |  | GB_PL2:SPAC13G6 | 33481 | Z54308 | S. pombe chromosome I cosmid c13G6. | Schizosaccharomyces pombe | 35,774 | 18 Oct. 1999 |
| rxa02571 | 1152 | GB_BA1:CGU43535 | 2531 | U43535 | Corynebacterium glutamicum multidrug resistance protein (cmr) gene, complete cds. | Corynebacterium glutamicum | 41,872 | 9 Apr. 1997 |
|  |  | GB_EST35:AI857385 | 488 | AI857385 | w155e03.x1 NCI_CGAP_Bm25 Homo sapiens cDNA clone IMAGE:2428828 3', mRNA sequence. | Homo sapiens | 39,139 | 26 Aug. 1999 |
|  |  | GB_BA1:CGU43535 | 2531 | U43535 | Corynebacterium glutamicum multidrug resistance protein (cmr) gene, complete cds. | Corynebacterium glutamicum | 38,552 | 9 Apr. 1997 |
| rxa02578 | 1227 | GB_PL1:AB016871 | 79109 | AB016871 | Arabidopsis thaliana genomic DNA, chromosome 5, TAC clone: K16L22, complete sequence. | Arabidopsis thaliana | 34,213 | 20 Nov. 1999 |
|  |  | GB_PL1:AB025602 | 55790 | AB025602 | Arabidopsis thaliana genomic DNA, chromosome 5, BAC clone: F14A1, complete sequence. | Arabidopsis thaliana | 36,461 | 20 Nov. 1999 |
| rxa02581 | 1983 | GB_IN1:CELF36H9 | 35985 | AF016668 | Caenorhabditis elegans cosmid F36H9. | Caenorhabditis elegans | 35,977 | 8 Aug. 1997 |
|  |  | GB_BA1:MTV005 | 37840 | AL010186 | Mycobacterium tuberculosis H37Rv complete genome; segment 51/162. | Mycobacterium tuberculosis | 39,173 | 17 Jun. 1998 |
| rxa02582 | 4953 | GB_BA1:MTV005 | 37840 | AL010186 | Mycobacterium tuberculosis H37Rv complete genome; segment 51/162. | Mycobacterium tuberculosis | 38,517 | 17 Jun. 1998 |
|  |  | GB_BA1:MTV026 | 23740 | AL022076 | Mycobacterium tuberculosis H37Rv complete genome; segment 51/162. | Mycobacterium tuberculosis | 38,548 | 24 Jun. 1999 |
|  |  | GB_BA1:MTCY338 | 29372 | Z74697 | Mycobacterium tuberculosis H37Rv complete genome; segment 127/162 | Mycobacterium tuberculosis | 46,263 | 17 Jun. 1998 |
|  |  | GB_BA1:SEERYABS | 20444 | X62569 | S. erythraea eryA gene for 6-deoxyerythronolyde B synthase II & III. | Saccharopolyspora erythraea | 45,053 | 28 Feb. 1992 |
| rxa02583 | 1671 | GB_BA2:AF113605 | 1593 | AF113605 | Streptomyces coelicolor propionyl-CoA carboxylase complex B subunit (pccB) gene, complete cds. | Streptomyces coelicolor | 58,397 | 08 Dec. 1999 |
|  |  | GB_BA1:SC1C2 | 42210 | AL031124 | Streptomyces coelicolor cosmid 1C2. | Streptomyces coelicolor | 52,916 | 15 Jan. 1999 |
|  |  | GB_BA1:AB018531 | 4961 | AB018531 | Corynebacterium glutamicum dtsR1 and dtsR2 genes, complete cds. | Corynebacterium glutamicum | 58,809 | 19 Oct. 1998 |
| rxa02599 | 600 | GB_BA1:AEMML | 2585 | X99639 | Ralstonia eutropha mmIH, mmII & mmII genes. | Ralstonia eutropha | 35,264 | 22 Jan. 1998 |
|  |  | GB_EST15:AA508926 | 422 | AA508926 | MBAFCW1C08T3 Brugia malayi adult female cDNA (SAW96MLW-BmAF) Brugia malayi cDNA clone AFCW1C08 5', mRNA sequence. | Brugia malayi | 43,377 | 8 Jul. 1997 |
| rxa02634 | 1734 | GB_BA1:AEMML | 2585 | X99639 | Ralstonia eutropha mmIH, mmII & mmII genes. | Ralstonia eutropha | 41,148 | 22 Jan. 1998 |
|  |  | GB_BA1:SYNPOO | 1964 | X17439 | Synechocystis ndhC, psbG genes for NDH-C, PSII-G and ORF157. | Synechocystis PCC6803 | 38,145 | 10 Feb. 1999 |
|  |  | GB_GSS9:AQ101527 | 184 | AQ101527 | HS_2265_A1_E11_MF CIT Approved Human Genomic Sperm Library D Homo sapiens genomic clone Plate = 2265 Col = 21 Row = I, genomic survey sequence. | Homo sapiens | 38,798 | 27 Aug. 1998 |
| rxa02638 | 999 | GB_IN1:MNE133341 | 399 | AJ133341 | Melarhaphe nerioides partial caM gene, exons 1–2. | Melarhaphe nerioides | 39,098 | 2 Jun. 1999 |
|  |  | GB_BA2:AE001756 | 10938 | AE001756 | Thermotoga maritima section 68 of 136 of the complete genome. | Thermotoga maritima | 40,104 | 2 Jun. 1999 |
|  |  | GB_GSS12:AQ423878 | 689 | AQ423878 | CITBI-E1-2575E20.TF CITBI-E1 Homo sapiens genomic clone 2575E20, genomic survey sequence. | Homo sapiens | 36,451 | 23 Mar. 1999 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02659 | | GB_HTG2:AC006765 | 274498 | AC006765 | *Caenorhabditis elegans* clone Y43H11, *SEQUENCING IN PROGRESS*, 7 unordered pieces. | *Caenorhabditis elegans* | 39,072 | 23 Feb. 1999 |
| | 335 | GB_EST36:AI900317 | 436 | AI900317 | sc04a02.y1 Gm-c1012 Glycine max cDNA clone GENOME SYSTEMS CLONE ID:Gm-c1012-1155 5' similar to SW:PRS6_SOLTU P54778 26S PROTEASE REGULATORY SUBUNIT 6B HOMOLOG.;, mRNA sequence. | Glycine max | 41,566 | 06 Dec. 1999 |
| | | GB_GSS12:AQ342831 | 683 | AQ342831 | RPCI1-122K17.TJ RPCI-11 *Homo sapiens* genomic clone RPCI-11-122K17, genomic survey sequence. | Homo sapiens | 34,762 | 07 May 1999 |
| | | GB_EST36:AI900856 | 779 | AI900856 | sb95c11.y1 Gm-c1012 Glycine max cDNA clone GENOME SYSTEMS CLONE ID: Gm-c1012429 5' similar to SW:PRS6_SOLTU P54778 26S PROTEASE REGULATORY SUBUNIT 6B HOMOLOG.;, mRNA sequence. | Glycine max | 39,063 | 06 Dec. 1999 |
| rxa02676 | 1512 | GB_IN2:CELB0213 | 39134 | AF039050 | *Caenorhabditis elegans* cosmid B0213. | *Caenorhabditis elegans* | 35,814 | 2 Jun. 1999 |
| | | GB_GSS1:CNS00PZB | 364 | AL085157 | *Arabidopsis thaliana* genome survey sequence SP6 end of BAC F10D11 of IGF library from strain Columbia of *Arabidopsis thaliana*, genomic survey sequence. | *Arabidopsis thaliana* | 38,462 | 28 Jun. 1999 |
| rxa02677 | | GB_RO:RNITPR2R | 10708 | X61677 | Rat ITPR2 gene for type 2 inositol triphosphate receptor. | *Rattus norvegicus* | 37,543 | 21 Oct. 1991 |
| | 882 | GB_RO:D89728 | 5002 | D89728 | *Mus musculus* mRNA for LOK, complete cds. | *Mus musculus* | 38,829 | 7 Feb. 1999 |
| | | GB_GSS8:AQ062004 | 362 | AQ062004 | CIT-HSP-2346O14.TR CIT-HSP *Homo sapiens* genomic clone 2346O14, genomic survey sequence. | Homo sapiens | 36,565 | 31 Jul. 1998 |
| | | GB_GSS14:AQ555818 | 462 | AQ555818 | HS_5230_B1_G06_SP6E RPCI-11 Human Male BAC Library *Homo sapiens* genomic clone Plate = 806 Col = 11 Row = N, genomic survey sequence. | Homo sapiens | 36,534 | 29 May 1999 |
| rxa02691 | 930 | GB_IN1:DME9736 | 7411 | AJ009736 | *Drosophila melanogaster* Idefix retroelement: gag, pol and env genes, partial. | *Drosophila melanogaster* | 36,522 | 19 Jan. 1999 |
| | | GB_PR4:AC004801 | 193561 | AC004801 | *Homo sapiens* 12q13.1PAC RPCI1-228P16 (Roswell Park Cancer Institute Human PAC Library) complete sequence. | Homo sapiens | 39,341 | 2 Feb. 1999 |
| | | GB_PR4:AC004801 | 193561 | AC004801 | *Homo sapiens* 12q13.1PAC RPCI1-228P16 (Roswell Park Cancer Institute Human PAC Library) complete sequence. | Homo sapiens | 37,037 | 2 Feb. 1999 |
| rxa02718 | 1170 | GB_EST34:AV132028 | 258 | AV132028 | AV132028 *Mus musculus* C57BL/6J 11-day embryo *Mus musculus* cDNA clone 2700087F01, mRNA sequence. | *Mus musculus* | 43,529 | 1 Jul. 1999 |
| | | GB_GSS10:AQ240654 | 452 | AQ240654 | CIT-HSP-2385D24.TFB.1 CIT-HSP *Homo sapiens* genomic clone 2385D24, genomic survey sequence. | Homo sapiens | 40,044 | 30 Sep. 1998 |
| | | GB_GSS11:AQ309500 | 576 | AQ309500 | CIT-HSP-2384D24.TFD CIT-HSP *Homo sapiens* genomic clone 2384D24, genomic survey sequence. | Homo sapiens | 38,869 | 22 Dec. 1998 |
| rxa02749 | 999 | GB_BA2:AF086791 | 37867 | AF086791 | *Zymomonas mobilis* strain ZM4 clone 67E10 carbamoylphosphate synthetase small subunit (carA), carbamoylphosphate synthetase large subunit (carB), transcription elongation factor (greA), enolase (eno), pyruvate dehydrogenase alpha subunit (pdhA), pyruvate dehydrogenase beta subunit (pdhB), ribonuclease H (rnh), homoserine kinase homolog, alcohol dehydrogenase II (adhB), and excinuclease ABC subunit A (uvrA) genes, complete cds; and unknown genes. | *Zymomonas mobilis* | 39,024 | 4 Nov. 1998 |
| | | GB_BA1:SYCSLRB | 146271 | D64000 | *Synechocystis* sp. PCC6803 complete genome, 19/27, 2392729–2538999. | *Synechocystis* sp. | 34,573 | 13 Feb. 1999 |
| | | GB_BA2:AE001306 | 13316 | AE001306 | *Chlamydia trachomatis* section 33 of 87 of the complete genome. | *Chlamydia trachomatis* | 38,940 | 2 Sep. 1998 |

TABLE 4-continued

ALIGNMENT RESULTS

| ID # | length (NT) | Genbank Hit | Length | Accession | Name of Genbank Hit | Source of Genbank Hit | % homology (GAP) | Date of Deposit |
|---|---|---|---|---|---|---|---|---|
| rxa02767 | 906 | GB_BA2:AF126953 | 1638 | AF126953 | *Corynebacterium glutamicum* cystathionine gamma-synthase (metB) gene, complete cds. | *Corynebacterium glutamicum* | 100,000 | 10 Sep. 1999 |
| | | GB_BA1:SCI5 | 6661 | AL079332 | *Streptomyces coelicolor* cosmid 15. | *Streptomyces coelicolor* | 37,486 | 16 Jun. 1999 |
| | | GB_PR3:HS90L6 | 190837 | Z97353 | Human DNA sequence from clone 90L6 on chromosome 22q11.21–11.23. Contains an RPL15 (60S Ribosomal Protein L15) pseudogene, ESTs, STSs and GSSs, complete sequence. | *Homo sapiens* | 34,149 | 23 Nov. 1999 |
| rxa02792 | 876 | GB_BA2:AF099015 | 5000 | AF099015 | *Streptomyces coelicolor* strain A3(2) integrase (int), Fe-containing superoxide dismutase II (sodF2), Fe uptake system permease (ftrE), and Fe uptake system integral membrane protein (ftrD) genes, complete cds. | *Streptomyces coelicolor* | 36,721 | 1 Jun. 1999 |
| | | GB_BA1:ECOUW93 | 338534 | U14003 | *Escherichia coli* K-12 chromosomal region from 92.8 to 00.1 minutes. | *Escherichia coli* | 38,787 | 17 Apr. 1996 |
| | | GB_HTG3:AC011361 | 186148 | AC011361 | *Homo sapiens* chromosome 5 clone CIT-HSPC_482N19, *SEQUENCING IN PROGRESS*, 69 unordered pieces. | *Homo sapiens* | 43,577 | 06 Oct. 1999 |
| rxa02794 | 1197 | GB_PR4:AC005998 | 96556 | AC005998 | *Homo sapiens* clone DJ0622E21, complete sequence. | *Homo sapiens* | 37,298 | 29 Jul. 1999 |
| | | GB_PR4:AC006008 | 57554 | AC006008 | *Homo sapiens* clone DJ0622E21, complete sequence. | *Homo sapiens* | 36,638 | 17 Jun. 1999 |
| | | GB_PR3:HSDJ73H14 | 95556 | AL080272 | Human DNA sequence from clone 73H14 on chromosome Xq26.3-28, complete sequence | *Homo sapiens* | 39,726 | 23 Nov. 1999 |
| rxa02809 | 375 | GB_RO:MUSSPCTLT | 3172 | M22527 | Mouse cytotoxic T lymphocyte-specific serine protease CCPII gene, complete cds. | *Mus musculus* | 47,518 | 19 Jan. 1996 |
| | | GB_RO:MUSGRC | 894 | M18459 | Mouse granzyme C serine esterase mRNA, complete cds. | *Mus musculus* | 44,939 | 12 Jun. 1993 |
| | | GB_RO:RNU57062 | 880 | U57062 | *Rattus norvegicus* natural killer cell protease 4 (RNKPA) mRNA, complete cds. | *Rattus norvegicus* | 41,554 | 31 Jul. 1996 |
| rxa02811 | 484 | GB_GSS6:AQ832862 | 476 | AQ832862 | HS_5261_A2_E10_SP6E RPCI-11 Human Male BAC Library *Homo sapiens* genomic clone Plate = 837 Col = 20 Row = I, genomic survey sequence. | *Homo sapiens* | 35,610 | 27 Aug. 1999 |
| | | GB_GSS5:AQ784593 | 515 | AQ784593 | HS_3248_A2_F02_T7C CIT Approved Human Genomic Sperm Library D *Homo sapiens* genomic clone Plate = 3248 Col = 4 Row = K, genomic survey sequence. | *Homo sapiens* | 38,956 | 3 Aug. 1999 |
| | | GB_GSS13:A0473140 | 397 | AQ473140 | CITBI-E1-2589G6.TF CITBI-E1 *Homo sapiens* genomic clone 2589G6, genomic survey sequence. | *Homo sapiens* | 34,761 | 23 Apr. 1999 |
| rxa02836 | 678 | GB_EST18:AA696785 | 316 | AA696785 | GM08392.5prime GM *Drosophila melanogaster* ovary BlueScript *Drosophila melanogaster* cDNA clone GM08392 5prime, mRNA sequence. | *Drosophila melanogaster* | 40,604 | 28 Nov. 1998 |
| | | GB_EST18:AA696785 | 316 | AA696785 | GM08392.5prime GM *Drosophila melanogaster* ovary BlueScript *Drosophila melanogaster* cDNA clone GM08392 5prime, mRNA sequence. | *Drosophila melanogaster* | 38,281 | 28 Nov. 1998 |
| rxs03212 | 1452 | GB_BA1:CGBETPGEN | 2339 | X93514 | *C. glutamicum* betP gene. | *Corynebacterium glutamicum* | 99,931 | 8 Sep. 1997 |
| | | GB_BA1:SC5F2A | 40105 | AL049587 | *Streptomyces coelicolor* cosmid 5F2A. | *Streptomyces coelicolor* A3(2) | 57,557 | 24 May 1999 |
| | | GB_BA2:AF008220 | 220060 | AF008220 | *Bacillus subtilis* rrnB-dnaB genomic region. | *Bacillus subtilis* | 40,000 | 4 Feb. 1998 |
| rxs03220 | 725 | GB_PL1:CKHUP2 | 2353 | X66855 | *C. kessleri* HUP2 mRNA. | *Chlorella kessleri* | 45,328 | 17 Feb. 1997 |
| | | GB_EST38:AW048153 | 383 | AW048153 | Ui-M-BH1-alq-h-05-0-UI.s1 NIH_BMAP_M_S2 *Mus musculus* cDNA clone UI-M-BH1-alq-h-05-0-UI 3, mRNA sequence. | *Mus musculus* | 41,758 | 18 Sep. 1999 |
| | | GB_PL1:CKHUP2 | 2353 | X66855 | *C. kessleri* HUP2 mRNA. | *Chlorella kessleri* | 38,106 | 17 Feb. 1997 |

APPENDIX A: DNA SEQUENCES

>RXA00051-upstream
CAGTAAAAGTGCACCGACACTAAGAATCCTTATCCTTCAGAGTAAGGTGATCTGCGTCAA
AAAATGTCCGCTATTCACCCGAAACGAGGTCAGCATCTCG >RXA00051
ATGAATGCCTCCCCTGCCCCAACCCGATCTTTTAAAGGATTGCGGGCTCGACACATTCAC
TTCATCGCGCTGGGTTCCGCGATCGGCACCGGCTTGTTCTACGGTTCCGCTGGCGCAATC
CAAGCAGCTGGTCCATCTGTACTCTTGGTCTACCTTCTCGGTGGCGCCGTCGTGTACTTC
ATGCTGCGCGCACTCGGCGAGATGGCTGTGCATCACCCAGTCCGTGGTTCCTTCGCGGTC
TACACCCGCGCACACCTTGGCGGATGGGCAGGCTACATCACCGGCTGGATGTTCGCGTTT
GAGATGCTCATCGTCTGCCTGGCTGACCTCACAGCCATCGGCATCTATATGAACTTCTGG
TTCCCCGGCACCCCACAATGGACTTGGGTGGTAGCCACCCTTCTTATTGTCGGTGGCGCA
AACCTCGCATCAGTGCGTTGGTTCGGTGAGCTCGAGTTCATCTTCACCATCATTAAGGTC
ACCGCAGTTGTCGCCATGATCGTCGGCGGCGCAGCCATCCTCGCATTCGGTCTCGGCGCC
AACGCTGAAGTTGCCGGCGTATCCAACCTCTGGGAGCACGGCGGATTCTTCCCCAACGGT
GTTGAAGGCATGATCGCAGCCTTCATCCTTGTTCTCTTCGCATTCGGTGGCACCGAAATC
ATCGGTGTTGCAGGCTCTGAAGCTGAAGATCCTGAGAAGTCCATCCCCAAGGCTGTTAAT
ACTGTCCCAGTACGCATCCTCCTCTTCTATGTGGGTGCCATCCTGGTGATCCTTGCCCTT
AATCCTTGGCCTTCCATCACCGGCGAAGAATCCCCATTCGTCCAGATCTTCGACACCCTC
GGCGTCAACTGGGCTGCTGGTCTCCTCAACGCCGTGGTCATCACCGCTGCACTGTCTGCC
ATCAACGCTGACCTCTTCGGCGCTGGCCGCGTTCTCACTGGTCTTGCGAAGGAAAACCTC
GCACCAAAGGCCATGGGCAAGATCGCCAAGAACGGCGTTCCAGTCATGACCACCACCATC
ATGATCATCGTCTTGATCGTGGGAGTAATCCTCAACGCAGTGCTTCCCGAGCGCGTCTTC
GAGATCGTCGCTTCCCTAGCAACCTTCGCCACAGTTTACGTCTGGCTGATGATCCTGCTC
GCACAGGTGGGATCCCGCCGAAACATGCCTGCCGACGAGGTCAAGTCCCTGAAGTTCCCT
GTCCCCTTCTACCCCTTCGGACAATACTTCGCGATCCTATTTATCGCCTTCACCTTCGGC
ATCCATGGTCTGGTACGACAACTACCACCTGCCACTCGCCGTCGGCGTTGGATTCCTTGTC
CTGATGACAATCCTTTACTACGCCACAGGCCGACCAAAGGCGATCGCTCCGATCGATTAT
GAAGAGCTAGATCCGCGACGCGAT >RXA00051-downstream
TAATCTAGACTCGCACGAAAAAG >RXA00091-upstream
TCATGAACCACGTGTTCCGCGCACAAGGCGTCGTGTCCATCATTATTGAGATGGTCGGCG
GTACCGTCTTCCTCATCGTCATCCTCAGAAAGGGCAGACT >RXA00091
GTGATTACGTTAACTAATGTCCGCAAGGAATACTCCAGCGACGTTGCCATCGGCCCCGTC
AACCTTGAGATCCCAGCCGGCGGCATCACCGCGTTGGTCGGCCCAAACGGTGCAGGCAAG
TCAACACTGCTCACCATGATCGGTCGACTCCTCGGCATCGATGAAGGCAACATCACCGTA
GCCTCCTACGATGTCACCTCAACCGCATCCAAAGATCTGGCCAAGATCATCTCCATCCTG
CGCCAGGAAAACCACTTTGTTACCAAGCTGACCGTGCGCCAGCTCGTAGGTTTCGGACGC
TTCCCATATAGCAAGGGCCGGCTGACGGAAGAAGACGAGGGAATCATCTCCCGCTACATC
GACTTCTTCAATCTCACCGAACTCGAAGACCGCTACCTCGACCAGCTTTCCGGCGGCCAG
CGCCAGCGCGCCTATGTCGCCATGGTGCTGTGCCAAGAGACGGACTACGTGCTTCTCGAC
GAACCCCTCAACAATCTTGATATCGCACACTCGGTGGAAATGATGAAACACCTCGAGAAT
GCTGCAGCCCAATTTGGCCGCACCATCATCGTGTTCTTCACGACATCAACTTCGCCGGCG
CGCTACGCCGATTACATCGTGGCCGTAAAGCACGGAATGATCGAAAAAGAGGGAACACCT
GAACAGATCATGAAAAACGAGATCCTTTCAGAAATCTTCAATACAGAGATCGAAGTTATT
GAAGGACCACACGGCAAGATTGCTTGCTACCAC >RXA00091-downstream
TAAATGAAGAGAAATAAGCCGAC

>RXA00092
ATCGCGAGAGCCCTCATCGGCCCCCGAAAAATCTTGCTTGCCGACGAACCCACCGGCGCC

Appendix A, page 1

Atto Docket No.: BGI-125CP

```
CTCGACACCTCCACCGGCGACGCAGTCCTCCGCGTCCTCCGCCAAAGAATCGATTCCGGT
GCCGCAGGCCTCCTTGTCACCCACGAACCCCGCTTCGCCGCGTGGGCAGACCGAACAATC
ATGCTTAGGGATGGTGAAATCCAG

>RXA00092-downstream
TGACCACACTTCTAGCAGCAACC

>RXA00104-upstream
TGCAAAGACATCCCGGAACCACTCCGCTACTTGAGGTCGGAATCGGGAAAGAATGCTTTT
AGCCATGCCTTAATGTAACCAAACATCTAGAATTGAGAAC >RXA00104
ATGACTGCTCAGATTGATGATTCGATCCTCACCCATCGTCTCGCCCAAGGCACCGGAGAA
ATCCTCAAAGGTGTCCGCAATGTTGGGGTGTTAAGAGGTCGGAATCTCGGTGATGCCGGC
GACGAACTCGCACAAAGTTGGATTGCTCGAGTGTTGGAGCAGCACCGCCCCAACGATGGA
TTCCTGTCTGAAGAAGCCGCCGACAACCCAGACCGCCTATCCAAGGACCGCGTGTGGATC
ATCGATCCCCTCGACGGCACCAAAGAATTCGCCACCGGCCGCCAGGACTGGGCAGTACAC
ATCGCACTGGTAGAAAACGGTGTTCCCACCCACGCCGCTGTTGGCCTCCCCGACCTTGGC
GTGGTGTTCCACTCCGCTGATGCCCGCGCCGTGACTGGCCCTTACTCCAAGGTCATCGCC
ATCTCCCACAACCGCCCACCAAAGGTTGCTCTATCTTGCGCAGAGCAGCTCGGCTTTGAA
ACCAAGGCCCTTGGATCCGCAGGCGCTAAAGCAATGCACGTTCTCCTCGGTGACTACGAC
GCCTACATCCACGCCGGCGGCCAATACGAGTGGGATTCCGCAGCACCAGTCGGCGTCTGC
AAGGCAGCAGGCTTGCACTGCTCCAGGCTCGACGGTTCCGAGCTGACCTACAACAACAAA
GACACCTACATGCCAGACATCTTGATCTGTCGCCCTGAACTTGCAGATGAACTTCTCGAG
ATGTGCGCGAAGTTCTACGAGGAGAATGGAACTTAC >RXA00104-downstream
TAACGCTGTTATGATGACGGCAT >RXA00113
GCTTCAGGTGGCGGAGTTGTTGATTCCGCAGCACTTGATGCCTACGCATCCACCGTCACT
GGTGAAGAAGGCGTCCTGGCAAACGTTGCTCGCGGCATTCTGTCTCAGCTTGGTCTCGAC
ACCAAGGACGAGGTTGAAGGCGCAGAGATCGACACCGAACTCTACGACGCTGTCGAAGCA
GAACTGGGCACCGGCTGGCTGAAGCTTGTCACCCCAGTGTTCTCCGCTGATCGTGCGATC
TTGTTCGACGACCGTTGGGCATCTGCACGTGAAGATCTGGCACGCCTTGCCAACGGCGAG
GATATTGCCGTCGAGCGCTTTGCTGGAACGGGGGAGACCGTCGTCAAGCAAGCTGCATGG
TGGGCTGAGCACGTTGAAGACACCGCTCTCGCTGCAACCCTGAAGCAGGTTTCCGAGGTG
GCTGCGAAGCCAGCCAACGAGCCACACATCGACGATGTTGCGCTGGTTACCGGTGCGGCT
CCTGAGTCGATCGCCGGTGCAGTTGCGGCTCGCCTGCTGTCCCAGGGCGCGACCGTCATT
CTCACCGCATCGAACGTCTCCCAGGCGCGTAAGGAATACGCACGCAAGCTCTACGCTGCG
AACGCAACCCCTAACGCAAAGCTGTGGATTGTTCCTGCGAACATGTCCTCCTACCGCGAT
GTTGATGCAGTCATCGATTGGATCGGCAACGAGCAGCGCGTCACCGTCGGCAGCACCGTC
ACCGTGACCAAGCCAGCTCTGACCCCAACCCTTGCGTACCCATTCGCAGCTCCATCCGTA
TCCGGTACCTTGGCGGATGCAGGCCCACAGGCTGAAAACCAGGCACGCCTGCTCCTCTGG
TCCGTGGAGCGCACCATCGCAGGACTTGCAGATCTTGCATCCCGCGGTGTCGATGGACGC
GTCCACGTTGTACTCCCAGGTTCCCCGAACCGCGGAATGTTCGGTGGCGACGGCGCTTAC
GGCGAAGTCAAGGCTGCTTTCGACGCCATCCTTGCCAAGTGGGGCTCCGAGACCGGCTGG
CCACAGTTTGTCTCCCTCGCACAGGCACGCATCGGCTGGGTCGCAGGCACCGGCCTCATG
GGTCGCAACGACGTGCTCATCCCTGCCGCTGAAAAGCTGGGCATCCACGTCTACACCCCT
GAAGAGATCTCTTCCGAACTGCTGGGTCTTGCATCCGCAGAATCCCGCGAAAAGGCTCTG
GAAGCACCGATCGATTACGACCTGACCGGTGGACTTTCCGGTGGCGTATCCATCGCAGCA
CTGGCAGCATCCCTCGAGTCCGACGCAGTAGAGACCACCTCTGCAGCAGAAGACACCATC
AAGGCGCTTCCATCACCTAAGCACCCAGAGCAGCCAGTGGGCACGCCAGTTGGAGAGGTC
AAGACCGATCTCGAAGACATGGTTGTCATGGTTGGCGTTGGCGAAGTCTCCTCATGGGGC
TCCGGACGTACCCGCTTCGAAGCTGAGTACGGCATCCAGCGCGACGGCTCCGTTGACCTC
ACCGCAGCAGGCGTCCTTGAGCTTGCATGGATGATGGGTCTGATCTCCTGGAGCGAAGAT
CCAAAGCCAGCCTGGTACGACGCTGACGGCACCGAAGTGCCTGAAGAAGAGATCTACGAG
CGCTTCCGCGACGAAGTCATCGCACGATGCGGTGTTCGTGAGCTTGTCGACGACGCATTC
CTCGTCGACGGCGGCTCCCTCGACGCAGCTGAAGTCTTCCTCGACCGCGACATCTCCTTC
TCCGTAACCTCTGCTGAAGAAGCACAGGCCTACGTCGATGCAGATGCTTCCGTGACCGTT
GAAGAAGCAGACGGCGAATGGATCGTGACCAAGAAGAAGGGCTCCACCTCCTTCGTGCCA
```

Appendix A, page 2

Att y Docket No.: BGI-125CP

```
CGCAAGGCAACCCTGACCCGCTCCGTAGCAGGCCAGCTGCCAACCGACTTCGACCCTGCC
AAGTGGGGTATCCCAGCCTCCATGATCGATGCACTCGACAACATCGCAGCGTGGAACCTG
GTCACTGCAGTCGACGCCTTCCTGTCCTCCGGCTTCAGCCCAGCAGAACTCCTGCAGTCC
ATCCACCCAGCTGACGTGCCTCCACCCAGGGCACCGGTATCGGTGGCATGCAGTCCCTA
CGCAAGCTGTTCGTCAACCGCTTCCTCGGCCAGGATCGTCCATCCGACATCCTCCAGGAG
ACCCTGCCAAACGTTGTGGCTGCACACACCATGCAGTCCTACGTCGGTGGCTACGGCCAG
ATGATCCACCCAGTGGCAGCATGTGCAACCGCAGCTGTCTCCGTGGAAGAAGGCGTGGAC
AAGATCCGCCTCAACAAGGCAGATTTCGTTGTCGCCGGTGGTATCGATGACATCCAGGTT
GAATCCCTGACCGGCTTCGGTGACATGAACGCCACCGCAGACACCCAGGCAATGCTGGAC
AAGGGCATCGACCCACGCTTCATCTCCCGCGCAAACGATCGACGTCGCGCAGGCTTCCTC
GAAGCAGCAGGTGGCGGTACCGTCCTCCTGGCACGTGCATCCGTTGCTGCTGAACTGGGA
CTGCCAGTTCTCGCAGTTGTTGCACACGCACAGTCCTACGCCGATGGTGCTCACACCTCC
ATCCCAGCACCGGGACTTGGCGCACTGGGTGCAGCACGTGGTGGCAAGAAGTCCGTACTT
GCTCGCGAACTGAACAAATTGGGTCTGACCCCAGATGACGTTCGCGTGGTCTCGAAGCAC
GACACCTCCACCAACGCCAACGATCCAAACGAGTCCGAGCTGCACAACCTGCTGTGGAAG
ACCATTGGACGCGAAGCCGACAACCCGATGTTCGTCGTCTCCCAGAAGTCCCTTACCGGA
CACTCAAAGGGCGGTGCAGCACTCTTCCAGATCGGTGGACTTGTCTCCATCCTGGAAACC
GGCAAGCTGCCACAGAACGCATCCCTTGACTGCGTTGACCCAGAGATGGAAGCAAAGGGC
GAGAACTTCGTCTGGCTGCGCAAGCCACTGGATCTCGGCGCAGGCTCCATTAAGGCCGGC
GTACTTACCTCACTGGGCTTCGGCCACGTGGCTGCAGTCGTCGTGCTGGCAACCAGCGGC
ATCTTCGAGCAGGCAATGCGCAACGCAGGCCTCGACGTCGAAGCATGGCGTGCACGCGCA
ACCCAGCGCCTGCGCACCGGTGCAAACCGCCTAGAAGCTGGCATGGTTGGCCGAGCACCA
TTGTTCGAGCAGGTCGACGGACGTCGCCTGCCAGAGCATGGCGCTCACCAAGCAGAGATC
AACTTGCTTATCGACGCTGACGCTCGCCTCGGTGCTGACGGCATCTACCAGGGC

>RXA00113-downstream
TAAACGTTAGATAGCTAAGAAAG

>RXA00158-upstream
CGTGCCATTTTCTTTACAAAAGAGTATTAACCGAAACTTCAGGTCAGGATCCACGCCCTG
CGTTCATCCCGGCTAAGTTATACAAGGAGCGAGTTCTCAC >RXA00158
GTGACCGAATTGAGCAGGAACTTCGGGGCCAGCCGACTGATTAACCGCTTTGGCCAGGAG
CCTTTTGCCTTCGCTTTCGCCGGCCAAGGATATGACTGGTTGAAGACCCTTCGTGCCGCG
GTTGCCGCAGGTGCAGGCACCAATGTTAGTGACATCGTCGAGCGCGCAAATGCGCTGCTT
GCACTAGTTGCAGATGATCTCATTGGCACCCTTCCATTTGGTTTCGATCCAGTGGCTTGG
GCTAACAACTCCGAAGATCCAGCTTTCGATACTGCACAATCTGCAGTGAGCGTGCCGGGT
ATCTTTGTCTCCCAGATCGCAACCCTGGATTCCCTTGAGGCGCAGCGCCTTGATGTGGAT
CAGGCTGTGTCCAGCATTGGTCATTCCCAGGGCGTATTGGGCGTGCACCTGCTCAATGAT
GCGACTCGTGCTGATGAACTCGTTGCCATTGCGCAGTTGATCGGTGCAGCGATCACCCGC
ACCGCACGCATGACGGGCCTGATCGCGCAGGGCGACAACATGCCGATGCTGTCGATCGCC
GGAATTTCCCGCGAACAGCTTCAGCAAGCTATCGACGCGGCCTGCGCCGAAGTCCCTGCG
GAGATCCGCCCGGTTATCGGTCTGCGCAACTCACGCGATTCTTATGTTTTGGTTGGCCGC
CCAGACGACAACGCTCGCGTTGTTAAGGTCATTGAGGCAATGGCTGCCAAGGATAAGAAG
GCCATTGAAGATAAGCTGCGCGGCGGTTCCGCGTTCAGCCCCCGTATTACTCCGCTGAAG
GTGCAGGCTGCTTTCCATCACCCAGCTATGAACATGGCTGTGGAGCAGACCGTGGCGTGG
GCAACCACTGCTGGTTTGGATGTGGAACTCACCCGCGAGATCGCCGCTGATGTTTTGGTT
AACCCTGTCGATTGGGTAGCACGCGTCAACGAAGCGTATGAGGCTGGCGCTCGCTGGTTC
CTCGACGTTGGACCAGATGGTGGCATCGTTAAGCTGACTGCCAACATCCTTGAGGGCCGC
GGCGCGGATTCCTTCTATGTTGGTGACGCCGCAGGCCAGGCCAAGATATTTGATGCTGGC
ATGGCACCTGAACTTCCAGTGGATTACCAGGAGTTCGCACCACGCGTTGAGCACGTTGAT
GGAACCCCACGCCTGGTTACCAAGTTCACTGAGCTGACCGGCCGCACCCCAATGATGCTG
GCTGGCATGACCCCAACCACCGTTGACCCTGCCATTGTTGCAGCCGCTGCAAACGGTGGA
CACTGGGCTGAGCTCGCTGGTGGCGGACAGGTTACCCCAGAGCTGCTGGAAACCCACATC
GCACAGCTCACCGACATGCTTGAGCCAGGTATCAACGCCCAGTTCAACTCCATGTTCTTG
GATCCATACCTGTGGAAGATGCAGATTGGTGGCAAGCGCCTTGTTCCTAAGGCCCGCGCT
AATGGTGCATCCATCGACGGCATCGTCATCACCGCCGGCATTCCTGAAAAGGATGAAGCT
GTTGCATTGGTCAAGGAACTGATGCGTGATGGTTTCCCTTGGATCGCATTCAAGCCAGGT
GCCATCAAGCAGGTTAACTCTGTGTTGGCTATCGCTAAGGAAGTTCCAGAACTCCCCATC
ATCATTCAGATTGAGGGTGGCGTTGCAGGTGGACACCACTCTTGGGAAGACCTCGATGAG
```

Appendix A, page 3

```
CTGCTGATCGCCACCTACGGCAAGGTCCGCGCACTGGATAACGTGGTGCTGTGTGTCGGC
GGTGGCATTGGCTCACCTGAGCGCGCTGCTGATTACGTCACCGGTTCCTGGTCCACTTCC
TACGGCCTGCCAGCTATGCCTGTTGATGGCATCTTGGTGGGTACCGCTGCGATGGCAACC
AAGGAAGCAACCACCTCCCAGGCCGTCAAGGAACTTCTTGTTTCCACCCAGGGCTCTGAT
GAATGGGTTCCTGCTGGTGGCGCAAAGAACGGAATGGCATATGGCCGTTCCCAGCTTGGC
GCAGACATCCACGAGATCGACAACTCCTTTGCTAAGGCTGGACGCCTTCTTGATGAGGTT
GCAGGCCATGAAACGGATTTGCAAGCGCGCCCGGATGAGATCATT

>RXA00164-upstream
CTGCTTTGCGGGAGGTTATGAAATGAGTGGGGAGACGTCGAAAAGCATGCGCTTTCCGTT
GGCCAGCCTGCCGCAAGTGCGGCGCGAGGTGGCCCGGCAG >RXA00164
GTGGGTCGTATTCCGCGGGCGAAGTGGTGGTTTTTAGGCGCGCTGGTGTTGCTGAGTGCG
GGCGCTTATGCGTCGGTGCTGGTGCCGCAGGTGCTGGGGCGGATTGTGGATCTGGTGTCC
GATGGCGCGCAGATGCGTGATTTTGTTGAGCTCAGTGTGATTCTCATTGCGGTGGCAATT
GCCGGCGCGGTGCTCAGTGCGTGCGGGTTCTATGTGGTGTCGCGGATTTCTGAGAAGATT
ATCGCCAATTTGAGGGAAGATATGGTGGGCACCGCGCTTGGGTTGCCCACGCACCAGGTG
GAAGATGCGGGCTCTGGCGATTTGGTGAGCCGCTCCACCGATGATGTCTCCGAGCTATCC
GCAGCGGTGACAGAGACCGTCCCGATTTTAAGTTCCTCACTGTTTACCATTGCCGCGACG
ATCATTGCGCTGTTTTCTTTGGACTGGCAATTTGTGCTCATTCCTGTCGTGGTGGCGCCG
GTGTACTACTTCGCGTCCAAGCACTATTTGAGCAAGGCGCCGGATCGGTATGCGGCAGAA
CGCGCGGCGATGGCGGAGCGTGCGCGAAAGGTACTTGAGGCTATTCGCGGGCGTGCAACT
GTGCGGGCGTATTCCATGGAAGATGCCATGCATAATCAGATTGATCAGGCGTCGTGGTCT
GTGGTGGTCAAGGGTATTCGTGCGCGCACCACCATGTTGATTTTGAACATGTGGATGCTG
TTTGCGGAATTCCTCATGCTCGCCGGTCGCGTTGGTGATCGGCTACAAGCTGGTCATTGAT
AATGCGCTGACGATCGGCGCGGTTACCGGTGCCGTGCTGATGATTATTCGTCTGCGTGGC
CCGATGAATATGTTCATGCGCGTGCTCGACACCATTCAATCCGGCTATGCGTCGCTGGCG
CGCATCGTGGGAGTTGTTGCGGATCCGCCGATTCCTGTGCCCGACAGCGGTGTGAAAGCA
CCTCAGGGCAAAGTGGAATTGCGCAACGTCAGCTTTAGCTATGGCGATTCCTGGGCGGTG
AAAGACATCGACATCACGATCAATTCCGGCGAAACTGTCGCGCTCGTGGGCGCATCTGGC
GCAGGTAAGACGACGGTCGCCGCCTTGCTGGCGGGCTTGCGGGTGCCAGATCAAGGGCAA
GTGCTTGTCGACGACTTCCCCGTCTCTCACCTCTCTGACCGCGAGCGTATCGCCCGCTTG
GCCATGGTCAGCCAGGAGGTTCATGTTTCTCCGGCACGCTGCGCCAGGATCTCACCTTG
GCTAAACCAGATGCCTCCGATGAGGAATTAGCGCATGCTCTTGGGCAAGTTAATGCCCTT
GACTGGTTGGAGAGTCTTCCAGAAGGACTGGACACGGTCGTTGGTGCGCGAGGAATCCAG
CTAGAACCAGTGGTGGCTCAGCAGTTGGCGTTGGCCCGGGTGTTGTTGCTCAATCCGGCG
ATCGTCATCATGGATGAAGCCACGGCAGAAGCAGGATCGGCGGGTGCCAGCGCACTGGAA
GAGGCTGCAGATGCAGTGAGCAAGAACCGTTCCGCATTGGTGGTGGCGCACCGGTTGGAT
CAGGCATCGCGGGCTGATCAGATTCTGGTGATGGATAAGGGGGAGGTTGTGGAATCCGGT
ACTCACCAGGAGTTATTGGATCACGGGGGTATTTATCAGCGTCTGTGGACTGCGTGGAGT
GTCGGAAGA >RXA00164-downstream
TAGTTGACTGTTCAATGCGTTGA >RXA00181-upstream
GTATATTCAGACACCCACGTCGATTAGTGTTGTAGTTCACAGTGCTTATTTTTTATTTGT
ATCTTTGCACGTTTGTCCCCTACCCAAAAGGAGAAACCTC >RXA00181
ATGAGCGATAACACCTGGTTCATCATAGCCATCGTTATCTATATGTTGGTGATGGTGCTC
ATCGGCTATTGGAGTTACCGCAAGACAGAAAAATACGACGACTACATGCTCGCCGGCCGC
GGGCTCAACCCTTTTGTTGCCGCAATGTCCGCAGGTGCCTCAGATATGTCAGGTTGGCTG
CTCATGGGTCTGCCCGGCGCGCTGTTTGTCACCGGCATGTCCGAGTTGTGGATCGCAGTC
GGACTCACCATTGGTGCATGGGCGAACTGGATGTGGGTGGCACCTCGTCTTCGTTCTTAT
TCCGAAATCTCGGCCAACTCAATCACCCTGCCTTCATTCTTTGAGAACCGACTTCGCGAT
AAATCTCGCGCGCTTCGCATCATTGCAGCACTAATTATCATTGTGTTCTTCACCTTCTAC
ATTCTTCAGGCATGGTTGCTGGTGGAGTGTATTGGGAGTCCACGTTTGGTGGAGATTAT
CTACTCGGTATGGCCATTGTCGCAGGTGTGACAGTGCTGTATACCTTCATTGGAGGATTC
CTTGCTGTGTCTTATACAGACGCAGTTCAGGGGACTATCATGTTCTTCTCGTTGATCATC
```

```
GTGCCAGTCATGGCATATTTCGCACTGGCGAACCCCATGGATATTTGGAGCTTTGCAAAC
TCTAATGATTACGGCCCGCACACCGATGGAATTGGCAATCCCACCTACTTCTCCATGATC
AGTGGCATTTCTGCAGCAGCAATCATTGGTAACTTAGGTTGGGGTCTTGGATACTTCGGC
CAGCCACACATTGTGGTTCGTTTCATGGCACTTCGCACACCAGCTGAAGCAAAGCAAGGT
CGTCGCATCGGTATTTCCTGGATGATAATCTGCCTGATTGGTGCAACCTTTACCGCAATT
ATCTCCACAGTTTTCTTTGCACAAAACCCCGACGCCAACATCACTGACACAAGGGCTTAT
GAGTCCATCTTCCTAGATCTTGCCCGGATGCTGTTCCACCCATTGATCGCTGGACTTATT
CTGACTGCTGTTCTCGCGGCCATCATGTCTACCATGTCGTCACAGCTGCTGGTCACCGCA
TCTTCCCTGATTGAGGACCTGCTGAAGGTAGTTAAAAAGGACTCGCTGAGCGAACGCACC
CTGATCATGCTGTCTCGTGCCACAGTCATCATTCTGGCAGTCATTGCAGCAGCCATGGCT
ATTAACCCGTCTGATTCCATCCTCGGATTGGTGGGATTTGCGTGGGCAGGATTCGGCTCT
GCATTTGGTCCGATCATACTTGCTAGCCTTTATTGGAAGCGTCTCAACGCCGCCGGCGCT
ATCTCCGGCATGATTACTGGTGCTATTGTCTCCATCGCGTGGGGTATGTCCCCACTAAGC
GATACGTTGTATGAAATCATCCCAGGTTTCGCCTTGGCAACCATCGTGATGGTCGTTGTT
TCCCTCCTGACAAAGGAACCCTCCGAAGAAATCCTCAACGAGTTTGAAACCGCCAAGGAT
CTTGCTGCCGCTGTGGAATCAAACGAGGATGTTGATTTCGCTGACGCAGCTCAGAAGCTT
TCGAAAGAAAGT

>RXA00181-downstream
TAAGCCTTAGAGGGAACCAAACG

>RXA00186-upstream
AGAAGCCCAGCATTTTGTTTAGCTCACCTCTAAAGCTCCTGATCTGGATACGAGGACTCC
TGCGGAAAACCGTGTGGCTAGTGAAGCTACCCGGCATCTC >RXA00186
ATGGGGGAGAAGACTTCTGTCGCGTATGTTCACGATGTTCTGATCAAGGGCGTGCCAGTG
CGGATATACAATCCGCACCCCAACGACGGGCCGCTTCCTGTCTTTATCTACTTCCATGGT
GGCGGATGGGTTTTGGGGGACCTTGAATCAGTGGATTCCACCGTGCGCGATATTGCCGTT
GCTTCAGGCGCCCTGTGTATCAGTGTGGATTATCGCCGTGCACCGGAACATCCTTTTCTC
GCTGCATTGGATGATTGCCAAGTGGTCACGGAAGCTGTCCTCAATGGTGAACTCGCCAGT
GCTAACCAGCATCTAGTGGCAGTCGGCGGGGACAGCGCCGGTGGCAATATTGCGGCGGTC
ATCGCTCAACAGCTGCGCGATCAGATCACCCACCAAGTTCTTGTGTATCCGGTGATGGAC
GTAATCTTGCTGGTGATTTGTTCTATCATTACCACTGGTTTTGCGCTGCTCATGCATCCA
AAGAGCAAGGACAAGACGGAGACGATTTCTGATGAATTCCTCGCAGAGATCCAAGCGGGA
AGTGAAAAGATCTCCATTCTGCGTTCGACCCCTGCTGAAAAAGCCAATGCGAGCCGTTGG
ATCATGTACTTCGTTGGCGGAATTGGCCTGCTCTACAGCGTGTTCAGCCTGTGGACAGGT
GGCGTAACCGGACTGACGTTGAACTCCTTCAACTTCCTGTTCCTGTCACTCGGCATGGTG
CTCACCGCTAATTACGGGCCAGAGTAT >RXA00186-downstream
TAAGCAAAGCTTATTCGCGAAGG >RXA00187-upstream
GCTTATTCGCGAAGGCATCCAAGGAACGTGGGGATTCATTCTTCAATTCCCGTTCTACGC
AGGCATTTTCGGGTTGATTTCCTTCACCGGTCTGGGTGTT >RXA00187
GTGATCTCCGGATTTTTCACCTCGATTTCCACGGCAACCACGTGGCCTGTCATCGCGTTC
CTCTACTCTGGACTGCTCAACATCGCGGTGCCTTCAGGTGGCTCGAAATTCATCATCGAA
GCCCCGTACATCATCCCAACCCCAGTGGATCTTGGCGCTGACATGGGCCTTGTCCTGCAG
GCTTATCAAATGAGTGATGGCGCGACCAACCTGCTCATTCCGTTCTTCGCGCTGCCATAT
TTGGCCAATTTCAAGATCAAATTCAGCCAAGTGGTGGGCTATACAGTTCCGCCTGTCCTC
GTTGTTATCGCCGTGATCTGCATTTACCTGTTCCTGCGAGCATCAATCATT >RXA00187-downstream
TAAAAAGATGCTTCTCG >RXA00201-upstream
ACGTCGCGGACTTCAAGTAGTCGGCGATGAAAAAGTCCGTTTACTAAACCCCGATCTGTG
```

Appendix A, page 5

```
TTACGCCATCGCGCGGCTCGGGCACACCGATACCTGGGCA

>RXA00201
GTGGCAGATTGCGGATTACCCATCCCAGAACACGTAGAGATCATCGATTTGGCACTCGTG
TTTGGGATCCCCACCTTTGAACAAGTACTGAATGCTCTCAAGCCGGAAGTAGTTGTGGAA
GGCGCGGTGATTGCCGAAGGGGCACCCCAACGTATCCGCGAAATGGTGGATACGGATGTG
GAAGTT

>RXA00228-upstream
CCGCATGGCATCCGCCGAAAGAATTCCCCTCCGGAGGAATGGCACGCCTCATGGGAGAAC
GCATCGGCAAAAACTGAC >RXA00228
ATGCGCGACCTCCGCTCCATGATCGGCGTCAGCTCCTCCGCATTAGGCAACCGAATCCCC
TCCGAAGAAAAAGTCTCTGACCTAGTCATCTCCGCAGGCTACGCAATCCTCGGCCGCTGG
CGCGAAGACTACGACGAAATGGACTTCGGACAAGCCACCGAAATCCTCGAACAAGTCGGA
GCCATGCACCTAGCCGACCGCACCTGGGGAACCCTCTCCGAAGGCGAACGCAAACGAGTC
CTGGTCGCACGCGCACTCATGACCAACCCGGAACTCCTCATCCTTGACGAACCAACCGCA
GGAATGGACCTCGGCGGACGCGAAGACCTCGTCGGCTACCTCGGAGAACTCGCCATGGAC
CCAGACGCACCTGCCATCGTCATGATCACCCACCACGTCGAAGAAATCCCCGCCGGATTC
ACCCACGCAATGCTCCTCGACGAAGGTGAAATCGTAGCCCAAGGCCTGATCAACACCGTC
ATGACAAACGAGAACCTATCCAAAGCATTCCACCAGCCAATCCAAGTAGACCGCATCGGG
GAACGCTACTTTGCCCGCCGTGTGAGAACCGCCAGGAGTCATAGGGCTCAG >RXA00228-downstream
TAGGTTTTTTGGAGTTGTGGGCC >RXA00243-upstream
CACTGCGCCAGATTTTTGATGCCGACACTGTGGCAGGTGTGCGCGCTGAGTACGAAAAAT
TTAACAAAGCAGCCCATGATGGAAATGAAGAGGAACAGAA >RXA00243
GTGACCAGCGAACAAGCTTTAGATCCTATCCACCCAGGTCAGTTCCGTCTTTCTCGGATT
CAGTTGATCAACTGGGGAACCTTCCACGGAACGGTGGACATTCCTGTGACCAGGGAAGGA
ATCTTAGTTACCGGTGGTTCGGGATCAGGAAAATCCAGCTGATTGATGCGATCACGGCG
GTATTGCTTCCGCAAGGAAAGCTGAGGTTTAACTCTGCCGCACAGGCTAATACTCCGCGG
AATAAGGGACGCAGTTTGGTTACCTATATCCGTGGCGCTTGGCGTGCGCAGGAGGATCCG
CTGCAGGATCAGATTGTCTCCACGTACCTACGTCCCCGCGCAACCTATTCGCTGGTTGGA
TTGACTTATTCCAACGGTGAAGGCGTCGAGCACACCTTGGTGGCTATTTTCTATCTGAAA
TCGGGACACAATTTAACCTCCGATATTTCTTCATATTATGGTGTGTTTCCCGTTGATCAA
GACATCAATGCGCTGCTGGATTTCCTGAAAGAGGGCATCGATAAACGCCAGATCAGAGCT
GCTTTCAAGGAAGCCATCTTTAGCGAGCAGCATTCTGTATTCTCCGGCAGGTTTAGAAGC
CGTTTGGGGATCTCCAGTGAGGAAGCTTTGCTGTTGTTGCACCGCGCGCAGTCGGCGAAA
GATCTTCAAAGCTTGGATGATCTATTTCGGGATTACATGCTGGTGGAACCGGATACGTTC
AGCATTGCCAAAACTGCCGTGGAACAATTCCAAGACCTTGAAGGTGCTTATGAGCAGGTC
GAAGATATTAAACGGCAGATCCACACCCTGGATCCTTTGGTGCAGCTGAAGAATCGGCGA
GAGAAAGCGCAACAGTCCAAAGATCATGCCAATGCACTGAAGAAGGCGCTGCCGACTGTC
GGGAATCGCATTAAGAAGGAAGAGCAA >RXA00259-upstream
GGCCTTATTAACATACGGCGGTTCTAGCACACAGCGATGGATGATGTGTCCCACCGATAT
TGCTGCATGTGCCAAGATTTAGCACGGTACAGTGCTAGAA >RXA00259
ATGAGCGGACTGTTTACCCCATTTTCAGATGCGGCAAAAAACAACACGGTAAAAACTGAT
GGAGATTCAGTATCTGGTCGAGACTTGCCTATTACTAAGATCTCTGAGGATCGTTTCGAG
CGTTCTGCGTATTCAGCCCAGCTGGCAAATATAATCTGCGATGTGGCACCTTGGGGAGCG
AGCACTGTTTTCAGTCTTACTGGTCAGTGGGGCAGTGGTAAGACATCTCTTGTTAATTTG
ATTCGCTCGGAAGAATCTCTATCGAACGAAAAATGGACAATCGTTGATTTCAACCCGTGG
GTGGCCTCTGACCCGCAATCTTTGATTGAGGAGTTTTACCGAGTAATCGTTGGGACGGTA
CCTGATGATAAGACCGGCCAAAAGATCAAAACTGTTCTGCAGAAAACCTTTAGCACGATT
```

```
GGGTCAATTGCAGGTGGGGTCGGAGGGTTTGGTGTCCTAGAAGCACTTGCGCTCTCAAAA
GGAGTAGATGCTGCAAACGCTGTATATAAGACATGGAAACAGGAGCAAGATTCGTGGCCA
ACGCTGTATACACGTGCTGCGAACCATTTTAAAGATCTGAACAAGCGAATTCTCATTGTC
GTCGATGATATTGATCGCCTCCATACTGATGAATTGGCGCTGTTAATGAAAGTAATACGC
TTGCTTGGACGATTCCCGCAGGTGAATTATCTTTTGGTTTATGAAGAAGAATCACTGTTA
ACGACGCTAGCCAGATCGACAGCTGTAGGTGGTAGCGAAGATGATGCTTTGCGTTTCATG
GAGAAAATCGTGCAGTATCCTTTCGATGTTCCGCCTCTGACATCATTTCAAATAGAGAAA
GAGCTCAGTGCATTATTTGACAAGCTTTTCCAGGGTGTTTCGCTATCGGGTGATCCTGAA
GACTTTGCACTAGTGAAGTCGAGAATGTTCGATGTCTGGGAAAAGACTCTGGTCACGCCG
AGGCTGTTGCACCGTTTTGCTGCTCTACTAACCAACTGGACTCGGATATATGGATCAGGT
GAAGTTAACGGCGTTGATCTCACAATACTTGCGACCATTCGAATTGTTTTTCCGTCTGTG
TATAAACGTCTTTCTCGAGCGAAGGAAGTATTGCTTCAAGGAGGTCGAACGACAGGCTCG
CAGAAACCCGGTTGGGAAAAGCAATTATGTGAGGGGATGAACAACGAGCAGATGGATCTT
TTAAAGACCATGCTTTTGTTCCTTTTCCCACGTCTTTCGGATCACCCTAGTACGAGAATG
CATCGTGAGAGGGGGATCTCGACGGAAGTTTATTTTGACACGTACCTCATGTTTCAAAGA
CCTGGACATGTCATAAGTGATGAACAGTTGGATAAGTATCTATCTAATGCGGACGATGCT
ATGGGTTTCGTCGATTTAATTAACTCCGATGACAATGACATGGTGGCATCAGTGATGAAA
AAGCTTCCTCTAGCAATTGATCGACTTGATGGAGAGGGTGTTAGGCACATGGCAGTTGAG
GTGTTATTCACCGCTGCTAATGGTATGCATGATAAAGGTCGTCAAGTGCGTATGAGCGGC
ATATTCAGTGACCTGTATTCCCATGCGTGCTCGATTCTTGGTGCATTGCCTCAATTACCA
GTGGAACAACTCTATGAGAAATTCTTTTCTGAGATGACGCTTAATGAGGCTGCTTTCTGG
TTAAACCAGGTGGGGAAAGGGCTAGAGCCTGTGGTAATGATGTAAGTGGCCTTGAGCTT
TTTCGTAAAGTTAATATAAAGACCGAAGCTAGAATTTTAAGTGTATTGAAGAATCAGGAC
CCCTCAGATTGGGATTTAGGTCCATATTCGCTTGGTATTTTGGCGAAAAGCTCGAATTTT
TCTTCAGTGCTGAAGTCTCTGCAAAGTGGTATAGAGGAACATCAGTTTGATGTGATAGAT
ATTGGAGTGCTTTTCTTAACGACTGTGTATTCTTCGCGACAGGGACCAAGCGGTGGTGCA
TGGATAGATTCTTTTCAGCATAGTCTGTTTTCACGGTACGTACCTGATTCTCTACGGGCT
ATAACCAAGTCTGAAGTAGATGTAGAACTAGGTAAGATACAGTTCACGGATTTTAGCTGG
GAAGGGAAGCGAAAAGTTGTCGCATATGCACTGGAGACTGGAAGAAGTGATTTCACTCGA
GAACGATTAGGGGGCTACAGTATCGCAGATTCTATAGTCGAT

>RXA00259-downstream
TGATGAGGCTGAGGTCATGACTT

>RXA00269-upstream
TGCGATCTTGGTGGTTGTCGCCATGCTGCTGCCGAGGTGGCGTGCGAAGTTCTCCAAGGC
ACCGAAGCCTAAGCAACCAGTAGCAGTGGAGGCTTAAGAC >RXA00269
ATGTTATCCATCAACGGAATTTCTAAGACGTTCTTCCCCGGCACTGTGAATGAGCGCCGC
GCGTTGCAGCAGCTCAAACTCGATATGGCTGAGGGCGATTTTGTCACCGTCATCGGTTCT
AACGGTGCGGGTAAATCCACGCTGCTCAACGCTGTTTCTGGCCGTTTGCTTGTTGATTCC
GGCGAGATTTCCATCGACGGCAACAAGGTAAACAAGATGTCAGAGCACAAGCGTGCCCGC
TACATCGGCCGCGTTTTCCAGGATCCTCTGGCCGGCACCGCGCCGAATCTCACCATTGAA
GAGAATCTGGCCATCGCGTTGCTGCGCGGCAAGCGCCGTGGATTGGCTTTGCACTGACC
TCGAAGCGCCGTGAGCAATTCAAGCAGGAACTTGAGCGCCTTGAGCTGGGTCTGGAAAAC
AGGCTCACTGCCAAAGTTGGTTTGCTCTCTGGCGGTCAGCGTCAGGCATTGTCCCTGCTG
ATGGCTGGTTTTACTCAACCTAAAATCATGCTGTTGGATGAGCACACCGCAGCGCTTGAT
CCACAGCGTGCAGAGCTTGTGACCACCTTGACCGAAAAGATCGTGGCAGATGGAAATCTG
ACTACGCTTATGGTCACGCACAACATGGAACAGGCAATTCGCCTGGGCAATCGCCTGATC
ATGATGCATGAAGGCCAGATTGTCTACCAGGCAGATCAGGCTACCAAGTCGAAGTTGACT
GTGCGCGATTTGCTGCAGGAGTTCGCCAACATCAAGGGCGCAACATTGTCTGACAAGGCG
TTCCTCGGC >RXA00269-downstream
TAAAAAGAGCTTGCTTTACGACG >RXA00281-upstream
GGTTGACTCTTTGGCTTTGATGCCAGCATTCGCCAAAGCGTGGCCCTCTTTAAGAAAGCT
ACTGAACACAACAGAGTAGGTTTATGCGACACTGGTGCGC
```

Atte... Docket No.: BGI-125CP

>RXA00281
ATGATCAACGTTGAAGGCCTCACCAAACAATATGGTCAGGTCCGCGCAGTCGATGATCTG
AGCTTCGAAGTAAAACCCGGAATAGTCACCGGATTTCTCGGCCCCAACGGCGCCGGAAAA
TCCACCACGATGCGGCTGATCCTTGGCTTAGATAATCCAACTGCAGGGCATGCCACGATC
GAAGGACAACCCTACCGATCGCTCAAAAATCCCCTGACCAAAGTGGGAGCACTGCTTGAT
GCCAAAGCAACACACCCAAATAGAACAGCAGAAAACCACCTCAAGTGGATCGCCCGTGCA
AATGGGCTGTCCACCAAAAGAGTCGATGAAGTTCTCACCCTCGTGGGACTGACTGGTGTT
GGGTCAAAGAAGACCGGTGGGTTTTCACTAGGCATGGGCAACGTCTAGGACTTGCTGCA
GCATTGCTCGGCGATCCGGAATACTTAATTCTCGACGAACCCGTCAACGGCCTTGACCCA
GAAGGCATTCACTGGGTGCGCACCTTGTTGCAAAACATCGCCAAGCAGGGCAGAACCGTG
CTCGTGAGTTCCCACCTGCTGTCCGAGATGGCGCAAACTGCGGAACATTTGATCGTGATT
GGGCGTGGCAAGCTGGTCGCCGATATGCCCATGCATGAGTTTGTGCGCTCCCATTCCGCT
TCCACAGTTGTGGTGCGGGCAGCA

>RXA00298-upstream
TTTAGACAAGTTCTGGTTAAAATTCTTCATGAAGGTGAGAATCTGGGAATTTCTCGGTAC
TCTTTCAGATTCGTAGTTATCCACTGATTGGAAGAATGAG >RXA00298
ATGAGCTCAAATATAGCTATCACGACCGAGCCTGAAGGGAAAAATAAAAAGGGTCTCAAA
TCAGACCCGTTCATTTTTTCCATTTCTGTCGGTTTTATCGTGGTGTTTGTCATCGCCACA
ATTGCGCTAGGCGAGAAAGCTCGAACAACCTTTTCCGCGATTGCCGGCTGGCTCTTAGAA
AATTTAGGGTGGATGTATATCGGGGGTGTCTCCTTGGTTTTCATTTTCCTCATGGGTATC
TTTGCGTCCCGGTATGGCCGGGTAAAACTTGGTGATGACGATGATGACCCCGAGCACACC
CTAATCGTGTGGTTCTGTATGCTTTTTGCTGGCGGTGTCGGTGCAGTCTTAATGTTTTGG
GGTGTTGCCGAACCGATTAACCACGCGTTCAACGTGCCAATGGCTAATGAAGAATCCATG
AGTGAAGCCGCAATTGTGCAGGCTTTTGCTTATACTTTCTATCACTTCGGTATTCACATG
TGGGTAATCATGGCACTCCCAGGATTATCATTGGGATACTTTATTTACAAACGTAAGCTA
CCTCCCCGTCTATCCTCTGTGTTTTCTCCGATCTTGGGTAAGCACATTTATTCCACACCC
GGCAAGCTCATCGATGTACTGGCCATCGTAGGCACCACGTTTGGTATTGCTGTGTCAGTA
GGTCTTGGTGTGCTGCAAATCAATGCAGGTATGAACAAACTATGGAGCACCCCGCAAGTA
TCGTGGGTTCAGCTTTTGATCATCTTGATCATCACCGCGGTTGCATGTATTTCCGTTGCT
TCCGGTTTGGATAAGGGCATTAAGTTACTGTCCAACATTAATATTGCAATGGCCGTTGCG
TTGATGTTCTTCATCTTGTTCACTGGTCCAACCCTCACATTGCTGCGCTTTCTCGTAGAA
TCCTTCGGAATCTATGCATCCTGGATGCCTAATCTGATGTTTTGGACTGACTCTTTCCAA
GATAACCCAGGCTGGCAGGGCAAATGGACGGTGTTCTATTGGGCATGGACTATTTGTTGG
TCGCCATATGTCGGCATGTTCGTGGCGCGTATTTCGCGTGGACGTACCGTCCGTGAATTT
ATCGGTGGGGTTCTAGCTCTGCCAGCGATCTTTGGCGTAGTTTGGTTCTCTATCTTTGGT
CGTGCAGGCATCGAAGTGGAACTGAGTAACCCAGGTTCTTGACCCAGCCAACTGTTGTT
GAAGGTGACGTGCCAGCAGCGCTTTTTAATGTGCTGCAAGAGTATCCGCTGACTGGAATT
GTCTCCGCGTTTGCACTTGTAATTATTGTGATTTTCTTTATCACCTCCATCGATTCCGCA
GCGCTAGTTAACGATATGTTCGCTACCGGTGCAGAAAATCAAACACCGACTAGTTACCGC
GTGATGTGGGCCTGCACCATTGGGCGGTCGCAGGTTCCTTGCTGATCATTTCCCCATCC
TCTGGTATTGCCACGCTGCAAGAAGTGGTTATCATCGTGGCTTTCCCATTCTTCCTCGTG
CAATTTGTCATGATGTTTTCTTTGCTTAAAGGCATGAGTGAAGATGCTGCTGCGGTTCGT
CGTGTGCAGACTCGTCAGTGGGAAAAGACTGATACACCAGAAAAACTTGAAGAGCATTCG
TCCCAACCAGCCCCGGGCTATGATGACGAGGGCAACCCCTTGCCAATGCCTGCCCTCGAA
CATGATGAGGACGGTAACATTGTTATCCCAGGCAACGTAGTCATTGAAGGTGATCTTGGG
GTAGTTGGTGATGTGGTCGACGATCCTGAGGAAGCCCAAGAGATGGGGTCTCGTTTTAAG
ATCGTCGAGCAAACTCGGCCCCAGTCCAGGGACGAATACGATATT >RXA00298-downstream
TAAACGATTGCTTTTCGACGCAC >RXA00346-upstream
ATCTATGAGACCCCTCAAAACACCGAGAATTTCCTCGATGCATTCACCAAGGCAGTTGAT
GATCTCACCGCTGCCACTAACCAGGTTTAGAATTATTTAA >RXA00346
ATGCTGTTGACTTTCAATGATGCTGCGGTGGATCCCCTCTGGAGGGGCCTGAATTTAGAG
CTCCGACAGGGGGAATTTCTTGCGGTTTTAGGCCCCAACGGCGTGGGAAAATCCACGCTC Appendix A, page 8

```
ATCGGTACGATTTTGGGCACCCGAAAACTCACCCACGGTTCGGTTAAAACTGATGCCCGG
GTGGGTTATATTCCGCAACAACGAATTTTCGATGTCCCGTTGCGTGCCCGCGATATGGTT
TCGCTGTCCGCGGCGCATGGCGTGGTTTCCAAAAGGGGACCCGCGAAGGGTGACGTCGAT
AAGCTTCTTGCCCGCGTGGGCGCTTCCGGAATCGCCGATCGACGCGTCGGCGAGCTCTCC
GGCGGGCAGCAGCAGCTCGTCCGCCAAGCCCAGGCCCTTGCCACGCGCCCGCAATTATTG
CTTGCCGACGAACCCCTCCTCAGCCTTGACCCCGGCGTCGCGCAGCGCACGGTGTCCCTA
TTTGGTGAATTGAAGGCCGAAGGCGTCGGCGTTGTTGTGGTCACCCACGATGTCAATCCA
CTAATGGGCCTGGTAGATCGCATTTTGTACCTCGCCCCCAACGGCCACACCATCGGCACG
GTTGGCGATGTCATGCAGTCCGAAAAACTCAGCGAACTCTACAACGCACCCGTCACGGTG
GCTCGCATCAACGACAGAATCGTGGTGGTT

>RXA00346-downstream
TAAGTGGATCTATCCACCTGGCT

>RXA00368
TCCCTCATGTTATCCCTGGGTGCAGCCCTAATCTGTGGGGTGCTGGGATGGCTGATCGGA
GTGCTCATCACCCGAACCCAGCATTTCGCCAACGTACCGTTGACACTCACTGTGCTGCTT
CCCACCGCACTGCCGGGCATGATCATCGGCGTCGGCTGGCTCATTTTGGGCAGATACACC
GGAATTTACAACACACCTTGGGTGATTTTGGGTGCATATGTGTGTGCTTTTACCGCGCTG
GTTGTCCAAGCTGTACGCGGACCACTCAGTCAAGCACCCGAAGCAATCGAAGAAGCCGCA
CGAATCAGCGGCGCAGGCAGATTACGATCCATCATGGACACCACCGGAGCGATGGCAATT
CCCGCAGCTTTCGCCGGCGCAGTGCTGGTTGCGGTAACTGCGGTTCGAGAGTTAACCGTG
TCCATTTTGCTCATCGCGCCGGGCACCACCACCCTGGGTGTGCAGGTGTTCAATTTGCAG
CAGGCGGGAAATTACAATCAGGCATCGGCGTTGTCGTTGATGTTTGCGATTATCGGTATC
GTGGCGCTCGCGTTGACGGTGCGCAGCCAGAAGGAGTTT

>RXA00368-downstream
TAGGTGTCATCGATCAAATTGCG

>RXA00369-upstream
GGCGGGAAATTACAATCAGGCATCGGCGTTGTCGTTGATGTTTGCGATTATCGGTATCGT
GGCGCTCGCGTTGACGGTGCGCAGCCAGAAGGAGTTTTAG >RXA00369
GTGTCATCGATCAAATTGCGCGATTTAAGCGTGAGCTTCCGCGACGGAACCTTCGGGCTG
CAAGATATCAATTTGAAAATTGAGCCGGAAGAATTTGTGGTGCTCATCGGGCCGTCGGGG
TCCGGTAAAACCACCATGTTGGGCACCATCGCGGGGTTTGTGGAGCCAAGTTCCGGCAGT
GTGCTCATCGCCGGCGAAGAAATGACGCATGTCCCGCCGGAGCGCCGTCGCATGGGCATG
GTGTTTCAGCAGCATGCGGTGTGGCCGCATATGTCGGTCGCCAAGAATGTGGGATACCCG
CTGGCGCGAAGTGGTCAGAAGGGGGCGTCGATAAGCAAACGCGTGGAGCGCACGCTCGCG
CTGGTGGGGCTTGAGGGGTTCGGCAGTCGCAGACCGGCCAGCCTGTCTGGTGGTCAACGT
CAGCGGGTGGCGCTTGCGCGCGCCATCATCGCCGACCCCACCGTGCTGCTTCTCGACGAG
GCCCTCTCCGCCCTCGACGAACCGCTGCGAGACGCTTTACGACGCGAACTCGTATCTTTG
ACCCGGCGCGAAGGCCTCACTACTGTGCACGTGACGCATGACCGCGCCGAAGCGATCTCC
ATCGCTGACCGCATCGTCGTACTCGGCAACGGTCGAATCCAACAGGTAGCCACCCCTACT
GAGCTCCTTTCCGCCCCCGCTACTGCCGATGTTGCCCGATTCATCGTCGACGCCACC >RXA00370
GGCAAAGCCCTATGGAATTCCGCCTATACAACAGTGCTTTCTGCGGTGGGCGCGACCATT
ATCGGCACGATCATGGCTCTCACGCTGGACCGAACTGATGTTTTCGGGCGCACCGCGTTG
CGGTTATTTTTGTTATCCCCGCTGTTGATCCCTCCGTTATTGGGGCTATTGCGTGGTTG
CAGCTGTTCGGGAAGAACCAGGGCATCAACCGGTTTTTCGGCACGGAAGTGTGGGATATT
TACGGCGCTGATGGTGTGACATTTTTGTTGATTGTGCACTCCTATCCCACTGTGTACATC
ATTGTTTCGGCAGCTCTGAGGCAACTTCCTAGTGATTTGGAGCAAGCTGCACGGATCGCG
GGGGCGGATACTTTTACGGTGTTGCGCACCATCACACTCCCACTGCTCAAACCTGCATTG
TTGTCGGCGTTTACTCTTACCACAGTGGCGAACCTCGCCGACTTTGGCATTCCAGCTCTG
TTGGGATCGCCAGCGCGTTTTGAAACCTTAGCCACCATGATTTATCGCTTCATGGAATCC
GGCACCGTGAGCAATCCATTGCAGGTGGTATCCACCATTGGCATCGTGTTGTTGTTCCTG
GGAATCGCAGCAGTAACCGCGGATTATCTGGTGTCTTTGTACGCGGCATCAAAGTTGCAA
GACGCAGGAACACCGCATCGCTTTACTCTCAACAAATCACGAATCCCAGTCAGCGTGATC
ACGTGGATCATCGCGTTGATCATCACCGCCGCCCCGCTGCTGGGTCTGGCATACAGAGCA
```

TTACTGCCTGCCCCAGGT

>RXA00410-upstream
GTGTTGATGCGTTAGTCCACCCACGCAGCTACGCCCCAAAGGAATAATCTTGAACCCTGC
CACAGATAACGCTCCGCCGGTCCTTTCAGCCCAAGATCTC >RXA00410
ATGATGATCTATGGAAAAGGATCAACAGAAGTTCGGGCTCTCGATGGCATTTCTGTACAG
ATTCAGTCCGACAAATGGACCTCCATCATGGGGCAATCAGGCTCTGGCAAAACAACTCTG
TTGCAGTGCCTTTCCGGATTGGCGCAGCCAACCTCAGGCAGAGTGACACTGAACAAAAAC
AACATCACGTTGAGCTCCCTGTCAGAAAATAAGCGTGCCAAGCTGCGTCGCACGCACATC
AGCATGGTGTTTCAGGATTTCAACTTGGTGCCTATTTTGTCGGTGAAGGACAATATTTTG
CTGCCGTTGCGTCTTGCGCATCGCAGGGTGGATAAGCAGTGGTTTGAACACATCACCAGT
GTGTTGAAGATTGATAATCGTATGCGCCATTTGCCTGGGGAGCTGTCTGGCGGTCAGCAA
CAACGCGCCGCGATTGCCCGGGCGTTGATGTCTAGGCCCGATATTGTCATTGCGGATGAG
CCAACAGGAAGTTTGGATTCCGTCACCAGCGATGCAGTGTTGAATTTGTTCCGCAGCATT
GTTGATGATTTTGGGCAGTCACTTGTGTTTGTCACCCACGATAAAGATGCTGCTCACCGT
GGTGACGTTGTTGATCACAATGCGTGATGGCAAGATCATCGATACGGCAGATTTGCGGGTG
GGGCGT >RXA00410-downstream
TAATGTTCAGGCTTGCTTTCGCT >RXA00419
GACAACGAAGCACAGTGGCGCGACCAAGCACTAGCAGTGGAAGCAACCACCGTGAACTAC
ACCGCCGGCGTTTCCGTAGGTGTACTGCTGGGCCAGAAATTTGAGCAGCAGGGCCACGGC
ACCATCGTGGCATTGTCCTCTGTGGCAGGCCAGCGAGTCCGCCGCTCCAACTTTGTCTAC
GGCTCCGCCAAGGCAGGTTTCGACGGTTTCTACACCCAGCTCGGCGAAGCCCTGCGTGGA
TCCGGTGCCAACGTATTGGTGGTTCGCCCAGGCCAGGTACGCACCAAGATGTCCGCAGAT
GGTGGCGAAGCCCCACTGACCGTCAACCGCGAAGACGTGGCAGATGCTGTTTATGATGCA
GTGGTGAACAAGAAGGACATCATCTTTGTCCACCCACTGTTCCAGTACGTCTCTTTTGCG
TTCCAATTCATTCCGCGAGCAATCTTCCGCAAGCTGCCGTTC >RXA00419-downstream
TAACGGAAGTTACGGAAGTTACG >RXA00421-upstream
GCTGGTTGAAGACTCGAAATGAGATCGACCCAACCGGAGTCTTTGCATCTGACATGTCCC
GCCGACTTGAGCTTTCTTAAGAAAGGGCTTGAACTAAACA >RXA00421
ATGCTTAACGCAGTGGGCAAAGCCCAAAACATTCTCCTTCTTGGTGGAACCTCTGAGATC
GGTATTTCCATTGTCTCCCGCTTCCTCAAGCAGGGTCCATCCCATGTGACCTTGGCAGCG
CGTAAAGATTCCCCACGCGTGGACGCAGCAGTCGCAGAG >RXA00432
TTGTCTGCGCTGGTTATTTTTGGCGGCGTGCAGCGTATCGCAAACGTGACGCAGTGGATG
GTTCCGTTCATGGCGGGTGCGTACATCATTGTGGGTGTGGTGGTGATTGTGATTAACATT
CAGCAGGTTCCGACCATGATCAACGACATCATTGCTGGTGCTTTTGGTTTCCGTCCGGTT
GCTACTGCGTCGGTGTGGGGCGCGTTCTGGTTGGCGTTTATGAACGGTATGCGCCGTGGA
CTGTTCTCCAATGAGGCTGGTGAGGGTTCTGTCCCGAACGCTGCTGCTACCGCGACTGTG
TCTCACCCTGTGAAGCAGGGTTTGGTTCAGACTCTGGGCGTATATTTCGACACCCTGCTC
GTTTGTAGCATTACCGCTTTTGTCATCCTGCTGTCTGGAGTGGAGTACGCGACCGGCGAT
ATTCAGTCTTCTTCTTTGACTCAGTCCGCGCTGGCTAGCGTTGTTGGTGGTTGGGGAACC
CACTTCATTACCGTAGTGATGTTCTTCCTGGCGTTTTCTTCCGTGCTGGGTAACTACTAC
TTGGCACAGGCGAATATTCAGTACTTCACCGATTCGAAGACTGTCATGACTGTTTTCCGA
CTCTTGGTGCTGCTCAGCGTGTTCTCTGGCGCGGTTGCTTCGGTGCCGTTGATCTGGGCT
TTGGGTGATACTTTCGCTGGCATCATGGTGCTCATTAACCTGGCGGCGATCATTCCGCTG
GGTGGCGTTGCAGTGAAGTTGCTTAAGAATTACACCATTCAGAAGAAGGCTGGTCTGGAT
CCTGTGTTCCACCGCGACATGATGCCAGAGGTTCGTAATATTGCGTGCTGGAACGGCAAA
GATGCAGCTACATCCAACTATCACGAAGCGATGGAAGTGATCAAGAAGAGC Appendix A, page 10

Attorney Docket No.: BGI-125CP

>RXA00432-downstream
TAGTCATCGAAGGAACAGTGGTA

>RXA00436-upstream
GGGATTTACTAAAAATCGGGTAACACGCGCGTAGTATTTTTCGC

>RXA00436
ATGGAATTATTGGAGACCTTCATCACTGATGTCATTAATGACAATTTGTGGATGATCTTG
CCCTTCTTGCTCGTTGCTGCTGGCCTCTATTTCGGTGGGCGTACGTTGCTGGTTCAGATT
CGGATGATTCCGGAGATGTTCAAAGCGGTCGTCGAGAAGCCTGCGAAGGATGGGGAGTTC
GCGGACAAGCAGGACATTTCGGCTTTTAAGGCGTTCACGATTTCTGCGGCGTCGCGAGTT
GGTACGGCGAATGTTGCGGGTGTTGCGCTGGCGATCACTCTGGGTGGACCGGGTGCAGTG
TTCTGGATGTGGATCATTGCGCTGGTTGGCGGTGCGACATCGTTCATTGAGTCGACTCTT
GGACAGTTGTGGAAGGTGAAGGACGGCGACAGCTATCGCGGTGGCCCTGCGTACTACATG
ACGCTTGGTTTGAATGCTCGGTGGCTTGCGGTTGTTTTCGGTGTCGCCATCACGTTGACC
TTTGGTTTTGTGTACAACGCTTTGCAGTCCAACGCGGTTGTTGAG

>RXA00449
CTGGCACTGACCGCTGAGACTGTGGGCGGAATGAAAAACCAAAAGAAATTCGCCACTGGA
CTCATGCTGTCCATTGCTTATTCTGCTTCCATCGGTTCACTCGGCACCTTAATTGGCACG
CCACCCAATGCCTTGCTTGCTGCGTATATGTCTGAATCGCATGATATCCACATCGGATTT
GGTCAGTGGATGATTCTTGGTGTACCAATTGCTGTCGTCTTCACCATCATCGCGTGGCTT
GTGTTGACCACCGTGTTCAAGCCAGAAATGAAAGAAATCCCTGGCGGACGTGAACTGATC
AAACGTGAAATCGCTGAAATGGGGCCGTGGACTGCACCTCAGGTCACAGTGGGTGTTATT
TTTGCGGCAGCTGCACTGGCTTGGGTCTTCATTCCATTAACTCTAGATTGGACCGGTTCC
CAGCTCTCTATCAATGACTCCCTCATTGGCATCGCTGCCGGCCTGCTGATGTTTATCGTT
CCCGCTAACTTTAAAACCGGCGAACGCATTCTTGATTGGCGTACTGCAGGCGAACTTCCA
TGGGATGTTCTCTTGCTTTTGGTGGCGGGCTTTCACTTTCTGCGATGTTTACCAGCACG
GGACTTTCCCTATGGATCGGTGAACTAGCTAAGGGACTTGATGCCCTTCCAATCTTCATT
CTCATCTTCGCCATTGCTGTCCTGGTGTTGTTCCTGACCGAGTTCACCTCCAACACCGCA
ACAGCGGCAACCTTCCTGCCAATCATGGGTGGCGTCGCCGTAGGTATCGGACTGACCGCA
GGTGGCGAGCAGAATGTTCTGCTGCTGACCATCCCAGTCGCACTGTCCGCAACCTGTGCG
TTCATGCTTCCAGTGGCAACGCCTCCAAACGCGATTGCATTCGGCTCCGGCTACATTAAG
ATCGGCGAAATGGTCAAGGGTGGTCTGTGGCTGAACATCATCGCAGTCATCCTCATTACG
ATTTTCACCTACTTCGTAGCGATCCCACTCTTTGGCATCATGCTT

>RXA00449-downstream
TAAAAGTTAACAGGCCCGCAGTC

>RXA00456-upstream
CTCACCAACCCGGAGATCGTCACAGCGGTGCTAACGGATCATGCCTAGCTTATGGCGTGC
TCGTCGCAGACTTTTGCTCATTGCCCTAGGTGTACTTGGT >RXA00456
GTGCTGCAGGCACTGCTGGCGATCATGGTGTCGTTGAGCGTAGCCGCCATACTTGAGGGA
AACCGAGCACTTGTTGGATTGCTGCTTGCTACCACGTTGGGTTTGGGGGTGGCGCAGTGG
ATTCAAAAAGTAGTGGCAGAAGATCTAGGCCAGCATTATGTGCATGAGGTGCGTCGTGAA
TTGGTGGGTGCTGCGCTGGTGCCTGGAAATACGGCCTCGTTGGGCGTGACTGTCACCCGA
GCCAGCAATGATCTCACCGCGGTGCGCAATTGGGTGGCTTTGGGCATTGTTCCGATGGTC
ACCGGGCTGCCG >RXA00459-upstream
AGGCGTGGCTGTTACTGTGCCACTGCTCAT >RXA00459
GTGTGTACCCGTGCTGCCGGTGGTGGCGCGGTGACTTTGAAAAGAGCACGTGAACTACGC
AAAAAACGTGGACGCATGGCTGCGCGGATCGCAGATTCTGTCATGGCTGGAGAATTACTG
CACGCAACAGGAGCAATAGACCGTGAGCTCAATGCAGTCACCCGAGATTCCGACCGAGTG
GTGATAGCTGCTGTAAGACGTTCCTGGGCCACCGGTTTTAGCCGCGCATTGATGGCCATG
GCAGCCTCGCTTGGCACTGTCAGCATTGTGATTTCTGGCCACCTGGAAGTAAGTGAGGTT GCGGGAATAATGATGCTTCTTGGCGTTCTTGCCACTCCAGTTGCAGAACTTGGCCGCGTG
GTGGAATATCGCCAAAATTATAAAGCCGCGACACGCATCCTGATTCCACTTCTGCAACGA
GGCTCAGAATTTAAACACTCCCAACAAAAACTACCCGGGTTGCAAGCAACAGAAGGAATC
CCCGGTGTCTATGTCAAAGGTATTTCCGCCCTTCCTGGAGAACGGATCTACCTCCACGGC
TCTGCAGATGCGACGAGAAATGGGTCACCTCGTTGTCTGCAATGGAGGAAGGCACAGAT
GTAATAGTCAACGGTCAAAGGCTTTCGCAGCTTCCTTTGAAACAACGACGCGCCCTCATC
GGAATCGCCTCAGCACACCACCACTTAAGCCGTGGTTCAGTATCGCGCCTGGTTGGTTTG
CGAGTGCCGGATGCCACCGTGGAAGAAATTGAGCAAGCACTGGAACAAGTTGGTCTGAAC
AACACCGGGAAACAACGCTTGAAAAACGGCGGACACCCCTGGAGTACTTCGCAGATCAAC
AAACTGAAAATTGCCAGCGCCACCCTTCGAACCCCACCGCTTTTGGTACTTGAAGGCATC
ACCCCTGAAAACCTCCTCAACTATCCCGGAGTGATCATCTCCACCGTTCAGGAGAACCCA
TCCGAAACATGGCGGCAAGTGAACATC >RXA00459-downstream
TAATCTAGAAACATGGCAGGACG >RXA00477-upstream
TGCGGGAGCGAATCAGAGTTCCACTTCATATCAAACTCTCTACACTCGCTAGAGCCACGA
TGAAAGGTCTATCTATGAGCATCTACAGAAAGAATTCGTG >RXA00477
ATGAAGGTCTCGACTAAAACTCCACGCTCCTCAGGTACCGCCGTAGTCATAGGCGCAGGT
GTTGCTGGTTTAGCCACTTCTGCACTTTTAGCACGTGATGGCTGGCAAGTAACTGTTTTG
GAAAAAAATACTGATGTCGGTGGCCGAGCTGGATCGCTTGAAATATCAGGCTTTCCTGGC
TTTCGATGGGATACCGGACCTTCTTGGTACCTCATGCCCGAGGCCTTTGACCATTTCTTC
GCACTTTTTGGTGCATGTACTTCTGATTATCTCGATTTGGTAGAATTAACGCCTGGTTAT
CGAGTTTTTCTGGCACACATGACGCTGTCGATGTCCCCACTGGGCGTGAAGAAGCAATT
GCGCTATTCGAATCCATCGAACCCGGCGCGGGTGCAAAACTAGGAAATTATCTTGATAGC
GCGGCAGACGCCTATGACATTGCCATTGATAGATTCCTTTATAATAATTTCTCCACGTTA
GGCCCGCTGCTTCACCGGGATGTACTGACCCGAGCTGGCCGACTGTTTTCTCTACTGACC
CGTTCTTTACAAAAGTACGTAAATAGTCAATTCAGTAGCCCGGTGTTGCGCCAGATCCTA
ACCTATCCAGCAGTCTTCCTGTCTTCCCGACCCACTACTACCCCATCGATGTACCACTTG
ATGAGTCATACCGATTTGGTGCAGGGAGTGAAATACCCTATAGGTGGTTTTACTGCAGTG
GTTAACGCTCTGCATCAGTTAGCGCTGGAAAACGGGGTTGAGTTTCAACTCGATTCTGAG
GTCATTTCCATCAACACTGCTTCATCGAGGGGCAACACAAGCGCCACAGGTGTGAGCTTG
CTTCACAACAGAAAAGTGCAAATCTAGATGCGGATCTTGTGGTTTCAGCAGGCGACCTA
CACCATACAGAAATAATCTGCTTCCCCGGGAACTTCGAACCTATCCCGAACGATATTGG
TCCAATCGCAATCCTGGAATTGGAGCGGTATTAATCCTCCTGGGCGTAAAAGGAGAGTTA
CCCCAGCTCGACCATCACAACCTTTTCTTCAGTGAAGATTGGACAGATGATTTTGCTGTA
GTTTTCGACGGGCCTCAACTTACCCGCCCCCACAATGCATCAAATTCCATTTATGTCTCC
AAGCCTTCAACGTCCGAAGACGGCGTTGCACCTGCTGGATACGAAAACCTTTTTGTTTTA
ATTCCGACCAAGGCCTCTAGCAGCATCGGCCACGGTGATGCGTATATGCAGTCGGCTTCA
GCATCCGTGGAAACAATCGCGTCACATGCAATCAATCAAATTGCTACGCAAGCCGGCATC
CCTGACCTCACTGACCGAATTGTGGTCAAACGCACCATTGGCCCTGCGGATTTTGAGCAC
CGCTACCATTCATGGGTAGGCAGTGCGCTGGGTCCAGCACATACCCTCAGACAGTCCGCT
TTCTTAAGAGGGCGCAATAGCTCCCGCAAGGTCAATAACCTCTTCTATTCCGGTGCCACC
ACCGTCCCGGGTGTAGGAATACCCATGTGTTTAATTTCTGCCGAGAATATTATTAAGCGT
TTACATGCCGATACCAGTGCAGGACCACTGCCCGAACCATTGCCGCCTAAAACGACACCA
TCTCAAAAGACCTCATACGATCAT >RXA00477-downstream
TAAATTTTGATCCCTATCATCGA >RXA00478-upstream
ACCAGAAGCAGCCTCAGCTATGACACACCAAAATTCGCCTCTCTTCCTTAAAAGTGCACT
GAGACTTTACAATCGGGCCTCATTCAAGGCTTCACATAAA >RXA00478
GTGATCGAAGAATATTCCACGAGCTTCAGTCTGTCTACGTGGTTGCTATCCCCACGCATA
CGAAATGACATACGAAATCTCTATGCAGTAGTTCGTATCGCCGATGAGATTGTCGACGGC
ACTGCACATGCCGCTGGTTGCTCAACTGCCAAAATCGAAGAGATTCTCGATGCCTATGAA

```
ATTGCGGTTCTTGCAGCACCACAACAACGCTTCAACACAGATCTTGTTTTACAAGCTTAT
GGTGAAACTGCCCGACGCTGTGATTTCGAACAAGAGCATGTAATAGCCTTCTTTGCATCA
ATGCGTAAGGACCTCAAAGCTAATACACACGACCCAGATAGCTTCACAACGTATGTCTAT
GGCTCCGCGGAAGTTATAGGCCTGCTTTGTCTCAGCGTTTTCAACCAAGGTAGAACGATT
AGCAAAAAACGGCTAGAGATTATGCAAAACGGAGCCCGCTCATTGGGAGCGGCATTCCAG
AAAATTAACTTTCTCCGTGACTTGGCAGAAGATCAGCAAAATTTGGGCCGATTTTATTTC
CCCAAAACCAGCCAAGGAACTCTTACTAAAGAACAAAAAGAAGATCTCATCGCTGATATC
CGTCAAGACCTAGCAATTGCCCACGATGCATTTCCAGAAATACCAGTGCAGGCTCGCATC
GGAGTGATCTCTGCTTATTTGCTCTTTCAAAAACTCACTGACCGAATTGAGGCTACTCCT
ACCGCCGATTTATTGCGGGAGCGAATCAGAGTTCCACTTCATATCAAACTCTCTACACTC
GCTAGAGCCACGATGAAAGGTCTATCTATGAGCATCTACAGAAAGAATTCG

>RXA00478-downstream
TGATGAAGGTCTCGACTAAAACT

>RXA00480-upstream
TTTATGGACCCAAATTCACACTTTCTGTACTTCATCAAAATAAAGCGCCATATACAACGA
TTGGGAATTTTTGCGAGATAACTGGCCGTGTGATACTCGA >RXA00480
ATGGACAATGGCATGACAATCACCACAGAACATTCAACTCATCCTGATCTTGATTTCAAT
GATGAGATTTATCGGGAACTAAACCGCATCTGCGCTTCGCTATCTCAACAGTGCAGCACA
TATCAACCAGAGTTCCGTACCTGCCTAGATGCTGCTTTCCAAGCTTTGCGAGGTGGCAAG
TTAATCCGCCCTCGAATGCTACTGGGGCTATACAACACGCTTGTAGACGATGACATTGAG
GTCAAACTCAACACCGTTTTACAGGTAGCAGTGGCTTTAGAACTACTGCATTTTTCCCTT
TTGGTTCATGACGATGTTATTGACGGAGACCTCTATCGCCGAGGCAAACTTAATTTTATT
GGGCAGATTCTCATGCATCGCACACCTGAAAGTTTTGCACAAATCCAGCGCGATCCAGAG
CATCTAGATTGGGCACAATCTAATGGACTGCTTATGGGAAATCTTTTTCTTGCTGCCACC
CATCAAATCTTCGCGCGCCTTGACCTTCCACATCACCAACGGGTTCGACTTTTAGATTTA
CTCAACCACACGATAAATGACACTATTGTGGGTGAGTTTCTTGATGTGGGATTAAGCAGC
AAAGCCATCAGCCCCAATATGGACATTGCTCTAGAAATGAGTCGGCTAAAAACAGCCACA
TACACTTTTGAACTTCCAATGAGAGCAGCGGCAATTCTCGCGGAACTACCTCAGGAGATT
GAAACAAAGATAGGTGAGATAGGCACAAACTTGGGCATCGCTTATCAATTGCAGGACGAT
TACTTATCTACTTTTGGTGACGCAGCCGAACACGGCAAAGATGCCTTTTCTGACCTTCGA
GAAGGAAAAGAAACTACAATTATCGCCTTCGCTCGAGATACTGCTAAATGGACTGATATT
CAAGACAACTTCGGCTCCGCAGATCTGAGCACCTCTCAGGCAGAGCGAATTCAACATCTT
CTCATACAGTGTGGAGCAAAGAATCACTCCTTGAATGCCATCTCCGACCACTTAAATATC
TGCCGTTCGATGATCAAAACACTAAGCCCCAGGTAGATCCCAAGGCTCAAAATTTATTA
CTTAAACAAGTTGAGCAACTAGCCAGCCGCAAATCT >RXA00480-downstream
TAGAACTAACCTTTACGCCTTTA >RXA00524-upstream
TCCTCGGCACCCGCTACCCCGTCGGAGTTGTCACCGGCGCATTCGGCGCCCCATTCCTTA
TCTATTTACTCATTCGTTCCAACCGCGCGGGAGTAACCCT >RXA00524
GTGACCACCAACCATCAACTATCCGCCGAAGAAATTTCCCTGGCGTACGGCGAGCGCACC
ATCATCGATTCGCTCAGCGTCGACATCGTCCCCGGCAAATCACCTCCATCGTCGGCCCC
AACGGATGCGGCAAATCAACGCTGCTGCGCGCCTTTGCGCGCCTCCTTAAACCTAGCGCC
GGGCAAGCGCTTATCGACGCCCACCCCCTTCCTTCACTGCCAGGCAAAGAACTAGCTCGC
ATGCTCGGGCTGTTACCGCAATCCCCCACCGGACCTGAAGGCATCGTCGTCGCCGACCTC
GTGGGCCGCGGCCGCCACCCCCACCAAGGACTC >RXA00526-upstream
GGTGGAGCAGGCGGCGGCTCCTTTTAGTCCTGCGGCCCCTTTTGACCCTGCAGCCCCTGC
CGTTTCTGCCAAGCAAACCGTGGGCCAGGTGATTTAGCCT

>RXA00526
ATGAGCCTCATCGAAATGCGAAATATTGTCAAGACCTACAACATTGGATCTGAAGGTGAA
```

```
CTCACCGTGTTGCACGGTGTGGATTTCCATGTGGACCGTGGCGAATTCGTGTCGGTTGTG
GGTACGTCCGGCTCAGGTAAATCAACGATGATGAACATCATTGGGTTGTTGGATAAGCCA
ACTGATGGCACGTACACCTTGGATGGCGTGGATGTGTTGGATATCAGCGATGATGCTTTG
GCGAGCCACCGCGCTAAATCGATTGGTTTTGTGTTTCAGAACTTCAATCTGATTGGCCGG
ATCGATGCGTTGAAGAATGTGGAAATGCCCATGATGTATGCGGGCATTCCGGCTAAGCAG
CGGAGAAGTCGTGCGGTTGAATTATTGGAAATGGTCGGGATGGGTGAGCGTCTCAACCAT
GAGCCCAATGAGCTTTCGGGTGGTCAGAAGCAGCGCGTGGCCATTGCTCGCGCGTTGGCG
AACGATCCTGAGATCATTCTTGCTGATGAACCAACTGGTGCGTTGGATTCTGCAACGGGC
CGGATGGTGATGGATATTTTCCACCAGCTCAACAAGGAGCAGGGCAAAACCATCGTGTTT
ATTACTCACAACCCTGAGCTTGCTGATGAATCTGATCGGGTGGTCACCATGGTTGACGGG
CGCATCATTGGGTCTGAGGTGAAACACTCA

>RXA00526-downstream
TGAGCCTTGCAGAATCAATTCTT

>RXA00559-upstream
CCCTTCAATCCAGTCTTTGACGGCCAATACGGCTTGCCGGGTTTCCAGCGGATCAATCCT
CATGAAGCATCAGCCTAGTACGAACCGTTAAAGTGTCCAT >RXA00559
ATGTCTGATAATCCGCATGAGAATCCCCGTGAGAATCCACACCGCTCCCCAGAAGTCGTC
CTTCGTTTCATGGCTGCCCCTACTGACGTTTTGATGGCTGGTAGCCATGGCGTTGGCGGT
GGCCGAGTCCTGGAATGGATCGATAAGGCTGCTTATGCTTGTGCTACCCACGGGTCTGGA
ACCTACTGCGTCACTGCTTATGTTGGTCACATT >RXA00570
CCAACCATCGTGATGGCCATGGTCGCAGGCATTTTCCTCCGCTTCGGACTCGACCTCATC
GACGCCAGCGTGACCGACCCGCTCATTGCACTTCCCATGGTCATAGTTTTTGTGGCATTG
AGCATGAGTCCCCGCTTGGCAAGCATCGCCCCACCCGTTGCAGTAGCCGCAGTAGTGGGA
ACCATCGTTGCCATCGCATCCGGCAAACTAGCGTCCGGAATTCTAGACAACGGAATTATC
TCCCGCCCCGTCTTTACCGCCCCAGAATTTTCCTTCGCCGCCATCATGGAACTCGTTGTT
CCCTTGGCGATCACCGTAGTCATTGTCCAAAACGGCCAAGGCGTCGCAGTGCTTAAAGCA
GCAGGTCACCGCCCCGGAGTAAACCTTGCCGCCGCGGCCTCCGGACTGTGGTCCCTACCC
ATGGCGTTGATCGGCAACATCACCACCTGCCTCACCGGCCCCACCAACGCGCTGATCGTC
GCCGGAGCAAAATCACAC >RXA00571
CAGATCGGTGCGCTCAGCCCAGCAGTCGCCGGCACCCTTGGTTCCTACGCCATGATCGGC
GTGATGATCGGTGCTCTATCTGCAGGTGCCGTTGGTGACCGCCTTGGTCGTCGCAAAGTT
ATGCTCACCGCAATCGTCTGGTTCTCTGTGGGCATGGCGCTGACCGCGTTCGCGTCCTCG
ATTGCGCTGTTCGGTTCTTGCGCTTCCTCACCGGACTTGGCGTGGGCATGATCGTTGCA
ACCGGCGGCGCAATCATCGCGGAGTTCGCTCCAGCGAATAGGCGCAACTTGTTCAACGCA
ATCGTGTACTCCGGTGTCCCAGCCGGTGGCGTGCTGGCTTCTATCCTTGCACTGCTCTTT
GAAGATGTCATCGGCTGGCGCGGACTCTTCCTCATCGGTGGATCCCCACTACTGTTCCTC
CTGCCACTTGCATACTTCTTCCTCCCAGAGTCCCCGCGCTGGCTCACCTCCCGCGGCCGT
GCTGCGGACGCCAAAGCCCTCTGCGCACGCTATGGGCTGCCGACGGAGGAATTTGTCGTC
GAAAAGCAGCAGGAAACAAAGGGCACCGGATTCGCTGGAATTTTCTCCTCCAAGTACCTC
ATGGGCACCATTCTCATCGGCGCAATGAGCTTCATCGGGCTGCTTTCGACCTACGGCCTG
AACACCTGGTTGCCAAAGATCATGGAATCCAACGGCGCAACCTCACATGATTCCCTGTAC
TCCCTGCTGTTCCTCAACGGCGGCGCAGTGTTCGGTGGCCTCATCGCATCCTGGTTCGCT
GACCGCATCGGCGCGAAGACCGTGATCACCTCCACCTTCGCTCTCGCCGCGATCTGCCTC
GGAGTCCTGCCAAACATCTCCTCCTGGCCAATGATGTACACCGCAATCGCATTCGCAGGC
GTCGGCGTCCTGGGCACCCAGGTTCTCACCTACGGCCTGACCTCGAACTTCTTCGGAACC
GAATGCCGCGCAGCGGGAGTTGCATGGTGTGCAGGATTCGGCCGACTCGGCGGAATCGTC
GGACCAGCAATCGGTGGCCTGATCATCGGCGCAGGATTCGGACCAAGCTCCGCATTCCTC
ATCTTCGCAGCAGCTGCCGCAATCGGCGCGGTCTGCACCTTGCTGATCCCGCGCTCCCCA
GCAGAAGTAGAGGTCAAGGTCGCGCAGGAACCACTTGCACGTGTC >RXA00571-downstream
TAACCCCAATTAATTCGAAACAA
```

Attorney Docket No.: BGI-125CP

```
>RXA00572
CAGTGGCTCAACCGCTACCTCGAGCTGTCTGGCCCTGTTGATGGTCAGTGGATTGATGCT
TCCTGGGCTGCACGTTTTGCCCAGATGCTGGAGCGTGCCGAGGCGCGTTTGATCGAGCAG
GATCATGGCCAATTTGAGCCAAGCCTGACGGTGGAGGATGGCGTCGACAAGCTTGTTGCT
GCTTACCCGCATGCCGCAACCGACCTGCTCACCCCGGCTGATGTCGCCTGGTTCTTGGGC
CTGTGCCGCACGCCGGGCAAGCCTGTGAACTTTGTGCCCGTCATTGATAAGGACGTGCGT
CGCTGGTGGCGCTCGGACTCCCTGTGGCAGTCCCACGATGATCGCTACACCGCTGATCAG
GTGGCTATTATCCCTGGTGTCGTCGCCGTTGCTGGCATCACCAAGGCCAACGAACCTGTC
GCTGACCTGCTTGATCGCTTTGTCGACGCCACCATCGAGCGCATCGATGAGCACGATTCC
CGCTCCCGCGACATCATGGGCAAAGTGCTTTCCTCACCTGGCACATTCTGGGCTGGCCGC
AACATCCCATCGGTGATCCACAGCCTTGGGCATGCTGACAAGTGGTCCCGCTCCGAATTC
GAAGCATTCCATAGCCCAACCGGCGCCAACTTGGTGTACGAAGACGCCGAGCACGCGATG
CTGACTGTGCCTTTGGCGGGTTCCACCGCATTCGGCACCACCGCTGAGCTGAAAATCCGT
TTCACCAGCCCCATCGACGCTCTGCCAAGCGCTGTCCCACTGGTCACCCAGGAAGACGCT
GAAGCCGCGATGGGTGAACTGACCCGCATCGCAGCTGGCGGCACCCTGGCAACTGTGAAC
AATGGCACCGCTACCTGGGAAACCTCCGTCGATGCCGGCGTCATCGCTGACTACAACAAC
GTCACCGCAGGCTACCTGCCAGCATCCGTTGTTCCTGCACACACCGCACCTGACGTGCTG
GTTGGCCGCGCATGGCCAGCAGTTTTCGCTGCCGTAAAGTCCGCAGTCATCCCAGGCACC
GATTCCGCATCCGTTGTGGAAGGCATGCTGTCCCTGGTTCACCTGGAGCACCACATTGTG
CTCAAGTCCGATGTCCCAACCGACGGCGCGCTGAAGGTTTCCGCGACTGCCGATGAGGTA
GTCGATACCGACCTGGGTCGCCTCGTGATCGTGCGCGCAGAAATCGCCGACGCAGAAGGC
AACCTGATTGCTACGTTGGCTGAGCGTTTCGCGATCCGCGGACGCAAGGGCAACGCTGTC
GCACGCACCAACACCTCCGCACTGCCAACCACCGTGGACACCCCACGCTCAGCTCGCGCA
GTGGCAACCGTTGTTGCACCTGAATCCATGCGCCCATTCGCTGTGATCTCCGGTGACCGC
AACCCAATTCACGTCTCTGATGTTGCGGCTTCCCTGGCTGGTCTGCCCAGGTGTGATCGTG
CACGGCATGTGGACCTCTGCCATCGGTGAACTGATCGCCGGTGCAGCATTCAACGATGAG
CAGATCCAAACTCCCGCAGCCAAGGTCGTGGAATACACCGCAACCATGCTGGCACCAGTT
CTTCCAGGTGAAGAAATTGAGTTCAGCGTTGAGCGCTCCGCAGTGGACAACCGCCCAGGA
ATGGGAGAGGTCCGCACCGTTACCGCAACCGTCAACGGCAACTTAGTGCTTACCGCCACC
GCTGTTGTGGCAGCTCCATCTACTTTCTACGCATTCCCAGGCCAGGGCATTCAGTCCCAG
GGCATGGGTATGGAAGCACGCCGTAACTCTCAGGCAGCTCGCGCTATCTGGGACCGCGCC
GATGCACACACCCGCAATAAGCTGGGCTTCTCCATCGTGGAAATCGTGGAAAACAACCCA
CGCGAAGTAACCGTGGCAGGGGAGAAGTTCTTCCACCCAGACGGCGTTTTGTACCTCACC
CAGTTCACCCAGGTGGGCATGGCAACTCTGGGCGTTGCTCAGATCGCTGAAATGCGTGAA
GCACATGCCTTGAACCAGCGTGCATACTTTGCTGGACACTCCGTTGGTGAGTACAACGCG
CTTGCTGCATATGCTGGTGTGCTGTCCCTGGAATCCGTTCTGGAGATCGTTTACCGTCGT
GGCTTGACCATGCACCGCTTGGTGGATCGCGATGAAAACGGTCTGTCCAACTACGCGCTC
GCAGCTCTTCGCCCCAACAAGATGGGTCTGACCGCAGACAACGTTTTCGATTACGTTGCG
TCTGTTTCCGAAGCTTCCGGTGAATTCCTGGAGATCGTTAACTACAACTTGGCTGGCCTG
CAGTACGCAGTTGCTGGAACCCAGGCTGGTCTTGCCGCCCTTCGTGCCGATGTTGAGAAC
CGTGCACCAGGTCAGCGTGCCTTCATTTTGATCCCTGGCATTGACGTGCCATTCCACTCC
TCCAAGCTGCGCGACGGTGTGGGCGCGTTCCGTGAGCACCTTGATTCCCTGATCCCAGCT
GAGCTGGATCTGGATGTGCTGGTTGGCCGCTACATTCCAAACTTGGTGGCTCGCCCATTC
GAACTCACTGAAGAGTTCGTGGCATCCATGGCAGAAGTGGTGGAGTCCACCTATGTCAAT
GAGATCTTGGCTGATTTCAAGGCTGCTTCCGCCGATAAGCAGAAGCTTGCCCGCACGTTG
CTTATTGAGCTGCTTGCATGGCAGTTCGCATCACCTGTGCGCTGGATCGAGACTCAGGAT
CTGTTGATCAAGGGCCTTCAAGCTGAGCGTTTCGTGGAGGTCGGTGTTGGCTCTGCTCCA
ACGCTTGCCAACATGATGGGCCAGACCCTGCGCCTTCCTCAGTACGCGGACGCCACCATT
GAGGTGTTAAACATTGAGCGCGATCGCCCAGTTGTGTTCGCTACCGATGAGGTTGTGCGT
GAAGTGGCGGTTGAAGAGACCCCAGCAGCTCCTGCAGAAACCACTGAAACCCCAGCAACC
CCAGCAACCCCAGCCCCTGTTGCAGCTGCAGCCCTGCCACCGGCGGCCCTCGCCCAGAT
GACATCAGCTTCACTCCTTCTGATGCCACTGAAATGCTCATCGCTATCTGGACCAAGGTT
CGCCCAGATCAGATGGGTGCCACTGATTCCATCGAGACCCTGGTTGAGGGCGTGTCCTCT
CGCCGTAACCAGCTCCTGCTGGATCTTGGTGTGGAGTTCGGCCTCGGCGCAATTGACGGA
GCAGCCGATGCTGAGCTCGGTGATCTAAAGGTCACCGTGTCCAAGATGGCTAAGGGCTAC
AAGGCGTTTGGCCCTGTGCTCTCCGATGCTGCAGCTGATGCCCTGCGTCGCCTCACTGGT
CCTACCGGTAAGCGCCCGGGATACATCGCAGAGCGCGTCACCGGCACGTGGGAATTGGGC
CAGGGCTGGGCTGACCACGTGGTCGCTGAAGTTGTGATCGGCGCCCGCGAAGGCGCATCC
CTGCGCGGCGGCGACCTGGCGTCACTGTCTCCTGCAAGCCCAGCGTCTGCATCAGATCTT
GATTCGCTTATCGACGCAGCCGTCCAGGCCGTAGCCTCCCGCCGCGGCGTTGCGGTCTCC
CTGCCTTCAGCAGGCGGCGCTGCCGGTGGCGTGGTTGATTCCGCAGCTCTTGGCGAGTTT
```

Appendix A, page 15

```
GCAGAGCAGGTCACCGGACACGATGGTGTGCTTGCTCAGGCAGCCCGCACCATCTTGACC
CAGTTGGGTCTTGATAAGCCAGCAACCGTTTCCGTGGAAGACACCGCAGAGGAAGACCTC
TACGAGTTGGTCTCCAAGGAACTCGGTTCTGATTGGCCACGTCAGGTTGCACCAAGCTTC
GATGAAGAAAAGGTTGTTCTGCTTGATGACCGTTGGGCTTCTGCGCGTGAG

>RXA00590-upstream
TACGCTGGCGCACACCGCATGCTGGACTCCGGACGAACCGGCCCCAACACGTCAAAGCTG
TTTCCAATTCTCTATCACCGGCATCCTGATCACTGGCCTC >RXA00590
ATGCGCGTGGTGCTCTTCCTCGCGGTTCTCGGTGTTGTCGCAGGTGGCGTCACCCTATCC
ACCACGGGCAACCCAGCCGCGGAAGCATTCCAGCACGCTGCAGGCGATATCGGACTACGC
ATCTTCGGCGCCGTGCTGTGGGCAGCGTCCATTTCCTCAGTCATCGGCGCCAGCTACACC
TCTGCAACCTTCCTGGTGGAAAACAAGCCAGAGAAGAAGCGTCTGCAAAACTGGGTGACC
ATCATCTTCATCCTGATTTCTTGCTCCGTGTTCATCATGCTCGGCACGGCACCAGCAATC
CTCTTGGTCTTCGCCGGAGCATTCAACGGTTTGGTCCTCCCCGTAGGCTTTACCCTGATG
ATCTACGTAGCGATCTTCCGCCAAAAA >RXA00591-upstream
GCAACGCCACAGGCAAAATCCAAAAGAACATCCTGCGAGACTTCACCATCCCCGTTTCAT
AAACCCCCCAACGTCACTTTGAAAACACTTGGAGAACGCA >RXA00591
ATGACTACATCTTCCACAGCTTCGCCGATCGCTGAATTACAAAACCTCAGCCCGAAGCAA
AGAAAATCAGAATCCCGGCGCGCGATTATATCCAGCTACTTGGGCTCCACGATCGAGTTC
TATGACTTCCTGTTATATGCCGCAGCCTCCGCGACGGTATTCCCCGCAGTGTTCTTTACC
AATCTCGATCCGCTGGCTGGAACCATTGCCGCCTACGGAACCTTCGCCGCAGGTTATTTA
GCTAGGCCACTTGGTGGAGCAATCTTCGGACACTTCGGTGACCGTCTTGGACGCAAGAAG
ATGCTTGTGTTGTCCATGCTCATCATGGGTGTGGCATCCACATGCATCGGCCTTGTCCCA
AGCGCTGAAATGATCGGAAGCATGGGCGCGGTAATCCTGATCATGCTGCGCATCTGCCAA
GGCATCGCTGTCGGTGGCGAATGGGCGGAGCTGCCCTCATGGCGCTCGAGCACTCAGAT
TCCAAGAAGCGCGGATTCGCCGCCTCCTTCACCAACGCTGGTGCACCAACCGGCGCTGCA
CTGGGAACCTTCGCGCTCGGTACCGCATCTGCTGTTCTCACCCAGGAGCAATTCCTTTCA
TGGGGTTGGCGCATCCCATTCCTGCTCTCTTTCGTTCTGCTGATTGTCGGCTTGGTTATC
CGCGCGAAAGTTAGCGAATCACCACTGTTCGCAGCTGCAGCGGCCGCCGAAAAAGCCAAG
CCAACCGAACGTAAAGTCCCCCTCTTGCAGGTTCTTCGCCGACCAAAGGCACTGATCTTG
ACCATGCTTGGCGGCGCATCAGGATTCGGACTTCAAGTTCTCTTGTCCACCTTCTCCATC
AGCTACGCAACACAATCCGGCATCGAAAGATCCAGCGTCCTCTACGCCTTCGCAGTCGCC
TCAGTGTTCTCTGTCTTCTTTGTGATCCTCTTCGGTCGCGTATCCGACCTCTTCGGACGC
CGACCCGTCATGATCATCGCGCTCGTACTGTTCGTGGCCTACCTGCCGGCATTCTTCCGG
ATGCTCACCTCAGACAACTGGTTCATCCTGCTCTCGGCATTCACCATCGCGCTCGCACTC
CACGCCATGCTTTACGGCCCACTAGCAGCGTTTATCTCCGAACAATTCGGAACCTCCGCG
CGCTACACAGGCGCATCCCTGGGTTACCAGTTGGCCACGCTCATCGGTGCAGGATTCACC
CCAACCATCCTGGCTAGCCTCTACGCGGGACCAGGCGGCGGAACCTCTGTCACCCCAGTC
ATCGTCTTCCTCGCAACGATGTCCCTAGTGTCCATCATCGCCATCGCAATCACCAGAGAA
TCAAAAGACCACGATCTTTCTACTTACGAACAC >RXA00591-downstream
TAAGGGGACGATAGGGTCAATTT >RXA00596-upstream
CCGCCACCGACGGCCTCTTGAACACCGATGCATACCAACAGGCTGTGCTCGGTGAAAATG
CCATCGGAGTGCCAAGCCCTAGCTACCAGGGAGGAAACTA >RXA00596
ATGCTTAACGCCCTGAAATTCATCCCATGGCTGATCGGCCAGATTTTCCTCTCTGGCTTC
AGCGTGATCACCGCTGCGGTAAAAAAGGACACCGGCTTCAACCCCGTTGTTATCCGCTAC
CCACTTCGAGTGACCACGGACTTCCAGATCGCAGCCCTGTCAACGTGCATCACCGCGACT
CCTTCCACCCTGTCCCTTGGCCTACGCGAACCCGCAAGCCCGGCGACCCCACCATTTTG
CTGATCCAAGCAGTGTTTGGTTCCGATCCAGTAGAAGTTTTTGAATCCATCGCCGATATG
GAACAACGCCTCGTCCCTTCGGTCGCTTCAATTGACCACGGCGTCCCAGGCCAAGGCCCT
```

TACAAGGAGATCCGCCCCAGCGATGCTGAGTGGCCAAGTCGCGAGATCGCTGACACCGCC
CAAAACACCGTCAGCCAAGACAAGAGGGAGTTT

>RXA00596-downstream
TAAAACAACATGACTGCTTTTGG

>RXA00607-upstream
CACTGCCAGCAACGCCAACGGTTGAACCCGAACCAGAAGGCGATGAAGACTGGCCCGAAC
CCATCAACCCCGCAGGCGATAACAAAGAGGAGGCAAACCG >RXA00607
ATGATTCTCGCACTGACAGTCGCGATACTTTTCGGTGGAGGTGTCTACCTCATTCAGCAA
CGCGGAATGGTGCGCATCGTCTTCGGCATGTCACTGATCGGCCACGCAGCGAACCTGACC
ATCCTGTACGCCGGTGTGCCCACGTGGCGCGGCGAAGCCTTCCCCGACAGGACCCCGCTT
ACCGACGCCGCCGATCCACTCCCCCAGGCCTTCGTCCTCACCGCCATCGTCATCGCGATG
GCCACCACAACCATCATGTTGGCCTTGGCAGCACTGGGACGCAGCGACGACACCCGGTCC
ATCGAACCAGATGACGATCAATCGCCTTTGACTACTAGCGCTCGTTCAGTCACCAACCCA
ACAGATCAGGAGGATAAAGCT >RXA00607-downstream
TAAATGGCCATGGATGTTCTCCT >RXA00623-upstream
TTTAAGCTTCGTCGGCAACGATCACACCACGTTAAATTTCGACCATCAATGACGGTGGCC
GTTTTTTGGCGAATCCCCAAAAAGGTCGAAGAGGAAGTTC >RXA00623
ATGGATTCAAACACAGAATCTTCAAGTGTTGAGGTCAAAAACGAACACATTAAAGTTCAA
AAGCCGCCGAAGAAGGACCGCACTCACTGGCTCTACATTGCGGTCATTATCGCATTGATT
GGCGGTATTACCCTAGGCCTGATTTCACCGGAGTTGGGCAAAGAATTCAAGATTTTGGGC
ACCATGTTTGTGTCCTTGATCAAGATGATTATCGCTCCAGTTATTTTCTGCACCATCGTC
ATCGGAATCGGTTCAGTCAAGGCAGCGGCAACAGTCGGACGCGCTGGTGGCATCGCCCTT
GCGTACTTCATCACGATGTCCACATTCGCACTCGCAGTTGGCCTGCTAGTCGGTAACTTC
ATCCAGCCAGGTAGCGGACTGAACATCTCAGTTGATGAAGAATCTTCATTCGCATCCACA
GAGAGCAGCCCTGAAGGACTCTTGGGATTCATCCACTCGATCATCCCTGAAACGTTCTTC
TCTGCATTTACTGATGGTTCGGTGCTGCAGGTACTGTTCATCGCCATCCTCGTGGGCTTT
GCAGCTCAGTCGATGGGTGAAAAGGGACAGCCCATCCTTGATTTCGTATCCCATCTGCAG
AAGCTCATCTTCAAGATTTTGAACTGGATTCTGTGGCTCGCCCCAGTCGGTGCATTCGGT
GCAATGGCCGGCGTCGTTGGCGAAACAGGCTTTGATGCCGTTGTTCAGCTCGGTATTTTG
ATCCTCGCCTTTTACGTCACCTGCGTGATCTTCATCTTTGGCGTGCTGGGCGCCGTACTG
AAGGTGTTCACCGGCGTGAATATCTTCAAGCTGGTCAAGTACCTTGCCAAGGAATTCCTG
CTGATCTTTGCTACCTCATCCTCTGAATCTGCCTTGCCAAACCTCATGCGCAAGATGGAA
CACATCGGTGTGGCTAAACCAACCGTCGGAATCGTGGTCCCAACCGGCTATTCCTTCAAC
TTGGACGGCACCGCAATTTACCTCACCATGGCATCTATCTTCATTGCCGACGCGATGAAT
ATGCCGATGAGCCTCGGCGAGCAGGTCGGTCTGCTTGTCTTCATGATCATCGCATCCAAG
GGCGCTGCTGGTGTCTCGGGTGCCGGTATTGCAACGTTGGCTGCCGGATTGTCTTCACAC
CGCCCAGAACTTCTGCACGGCGTTGACGTGATTGTGGGCATCGATAAATTCATGTCTGAA
GCCCGCGCACTAACCAACTTCGCCGGAAACTCCGTGGCAACACTGCTGGTCGGCAAGTGG
ACTGGCACCGTGGACATGAACCAAGTCCATGACGTTTTGAATGGAAAATCTCCATTTGTG
GAGTTAGAAGAAGACCAC >RXA00623-downstream
TAGTTTTCAACAGGACGACAACG >RXA00660
CCAGGCCATACCCCGGAACACTTATCGTTCCTGCTGAAGGACGGCGCGTTCGCACATGAG
CCAGGATTCATGCTCACTGGCGATTTCGTTTTCGCGGGTGATCTTGGCCGACCAGATTTG
CTCGATGAAGCAGCTGGGGGAGTGGACACTCGTTTTGAGGGGGCTCGCCAAATGTTCAAG
AGCTTGAAGGAAAAATTCCTGACATTGCCTGATCACATCCAGATCTTCCCTGGTCATGGT
TCCGGTTCCGCGTGTGGCAAAGCCTTGGGTTCGGTTCCTTCAACAACACTTGGATATGAA
CGTCAATTTGCGTGGTGGGGAAAGTATCTGGAGGCAGATGATGAACAAGGATTCATTGAT Appendix A, page 17

```
GAGCTTCTGGAAGGCCAACCTGATGCACCTGCATACTTCGGCAGGATGAAGAGGCAAAAT
AGGCAAGGGCCCGCAATTATGGGCGCTCGCGAGCTGTTGCCACAGCTGGAAGCTTCTGAT
CTGCACGACGTCATTGTTGTTGATACCCGCTCAGCCGATGAAGTTCACCAGGGCACTGTA
GCTGGTGCAGTGAATATTCCTGCGGGCAATTCGATGGCGAAATTTGGCTCGTGGACCGTT
GATCCCGAGAAGGATTCCCGAGCTTTGGTTCTGCTCGCGGCAAGCCAAATTGGTGCCATG
GAGATGTGGGACCACATGGTTCGCGTGGGAATCGATAATGTTGCTGGTTTTATCACCAAC
TTTGATGGGGTGGACCTAGTTGCACCGCAAACTGTGTCCCCAGATCAGCTGGATGAATTG
GAATACGATCTACTTCTTGATGTCCGCAACCGCAGTGAAGTCGAAGAAGGCTACATCCCA
GGAGCACTCCATATTAATGGTGCATCCGTGCTGTGGAATCTGGAGAAACTGCCACGTGAC
GGAAAGATCGTGAGCTACTGCAAGAGTGGAACACGCAGCTCAATCGCCGCAAGCACCCTG
CGTAATGCTGGTTTTGATGTGGTGGAACTTCAAGGATCCTATGACAACTGGGTCCGGCAC
AAC

>RXA00681-upstream
AAGGGCAAGGTTGTCATTGTTGATCCAGATGCGCCACGCATCGAAGGACCCGGCGCGCAC
AGCCATGCGCACTCAGTAGCAGCACATGGGGTGGATACAC >RXA00681
ATGCCTAGTCCACGCACTGTTCTTATCACTGGTGCCGCTGGCGGTTTGGGTCGGGCATTC
GCTGAAGGTTTCGCAGCCCAAGGAGACCGTATCGCGGTGGCGGATATCAATCTGGATGGG
GCGCAAGAGACCGTTGACAAGCTGAAAGCATTGGGCGCAGATGCCGCAGCCTTTGAAGTT
GATGTCACGTCTTTGGAGTCCACCGAGGCCCTAGCCGCCGGTGCCGCTGAGTTTGGCGGT
GGCCGAATTGATGTCCTTATTAATAACGCAGCGATATATGCGACAGTGACTCGTTCACCG
TTTGAGGATATTGACCCTGCGGAGTGGGATTTGGTCATGGGAGTCAATCTCAAAGGCCCG
TGGTTGGTGACGCGTTCTGTGAGTCCGTTTTTGTCCGATAATGCCCGTGTGGTCAATCTT
TCCAGCGCGACTGTGTTTTCAGGATCTGCACACTGGGCGCACTACGTGGCATCCAAAGGT
GGGGTCATTGCTTTAACCAGGGTGCTTGCTAAAGAGCTGGGTGGTCGTGGGATCACGGTC
AATGCGGTTGCGCCTGGGTTTACGCTGACTGAAGCCAGCTTGGGACTCATGGATAGCGCG
GAAACGTACGGTGTCGATCGCGGATCCATCAAGCGCGCAAGCCAACCGAAAGACATCGTC
GGCACCACCATGTTTCTTGCATCCCCAGAAGCCGAATACATCACTGGGCAAACACTCATC
GTTGATGGTGGCCGACAGTTCATC >RXA00681-downstream
TAAGTACTAAAAGTTCTAAGGAG >RXA00690-upstream
ATGGATCATTGGACTCACACTGGCTGTCATTTCCTTGGTTTCAGCGTCTGCTGTGGCGGC
GTGGGCGATTCGTCGTTCAGAGGTCCAGGGTTAAAGCTTC >RXA00690
GTGAAATGGATTGAGCGATATGTGCTGTCCCGGCGGATGGTTCATCCCTGGGCGTGGTGG
GTGTGGGCGTTGGGTATTGCTGGTTGTGCCAGCATGACCAACAATCCTTATATTTTGGCG
CTCACTTTTGCCACGTTGTGTTTTGTGGTGTTTAACCGTCGTGGGTCATCGCCGTGGTCG
CGTGCTTTCCCGATCTATTTGATGATCGCGGGTTGGCTCGTGGTGTACCGGTTGGTCATG
CACATTGTGGTGGGAGCAAAAATTGGCACCATTGAACTGTTTCGGATCCCGCCGGTGCAG
TTGCCGGAATGGGCTGCGGGTATCCACGTGTTTGGCACGGTGTATCTCGAGGGTCTGATC
ATCGCGACGACGCAAGGCTTAACGCTTGGAACGATGATCGTGGCGGTGGGTGCTGCGAAC
TCTTTGGCGGATCCCAAGAAGCTGCTCAAATCGTTGCCTGGCGCATTGGGCGAACTGGGA
ACTGCGGTGGTCATCGGTATTTCCATTGCACCTCAGATGGCTGAGTCGGCGTTCCGCATT
AATCGTGCACGAACCTTGCGTGGTGATGATGCCAAAGGTGTTCGTGGTTTCGCGCGGATT
TTGATGCCGGTTTTCCAGGACACTTTGGATAGGTCTTTGGCCCTGCTAATTCCATGGAT
GCCCGTGGTTATGGCAGGCAGGCTCATGTATCCAAATTCCAACAGCGTGTGACCTCTATT
TTTGGTGCATTCGGAATACTCGGCGTGACCGTTGGTCTGTTTGTGGTCTTAGATGCATCA
TCACCGATGTTCGTTGCCGTTCCGGTGTTTATTACCGGCGTGGGCTTCTTGATCATTTCG
TTGGTCGTTGCTTCACATAGAAAAACATCCACCACTTTTGATCAGTTGCCTTGGGGTGCT
GCGGAATGGCTTGTGTGCATCACAGGTGTGATTCCGCTGCTCATGGCTGCGCTGACACGA
TACCTTGATCCAGGTTCCATGATCACCACCTGGGTTCCTTTGCATATGCCAGACACCGTT
CCGTTGCTCGTTGTGGCAGGACTTGTTGTGGCGACGATGCCAGGATTCTTGACGCCCCGC
TTGCCGAAGAACAAAGTGAGGGTCAAGCGTCGAAAAGCAATAAATAGCCCAGAAAGGGCC
GAAGTT
```

>RXA00690-downstream
TAATGAGTGCTCCTTTTAGCGCG

>RXA00733-upstream
ACGGCGAGGTTGTCGGTATTGGAACGCACACGAATTTGCTGAACACGTGCGGTACCTACC
GTGAAATTGTTGAATCCCAAGAGACTGCGCAGGCGCAATC >RXA00733
ATGAGTAATACTGCAGGCCCCCGCGGGCGTTCCCATCAGGCAGACGCCGCGCCGAATCAA
AAGGCACAGAATTTCGGACCATCTGCCAAAAGGCTTTTCGGAATTCTAGGCCATGACCGT
AACACCTTAATTTTTGTTATCTTCCTAGCCGTCCTGAGCGTTGGACTTACCGTCTTGGGC
CCATGGTTGCTGGGTAAAGCCACCAACGTGGTGTTTGAAGGATTCCTATCTAAGCGCATG
CCGGCTGGTGCGTCAAAGGAAGATATCATCGCGCAGTTGCAGGCTGCAGGTAAACATAAT
CAGGCTTCCATGATGGAAGACATGAACCTTGTTCCAGGCTCAGGCATTGATTTTGAAAAA
TTAGCCATGATCCTCGGACTGGTGATCGGTGCTTATCTCATTCGTAGC >RXA00735
GGTCCCACCGGTGCGGGCAAGACCACATTGGTGAATCTGATCATGCGTTTCTACGACATC
AACAGCGGTTCCATCACTCTTGGTGAAACAGCACAAGACGCCGTGGATATCCGCACCATG
GCTAGAGAAGATCTGCGATCACGAACCGGCATGGTGTTGCAGGATACGTGGCTGTTTGCC
GGAACCATCAGGGATAACATTCTTTACGGTAGACCTGAAGCAACTGAGGAAGAAATGCTT
GCTGCGTCCAAGGCCGCCTACGTGGATCGTTTTGTCCGTTCCCTGCCAGAAGGCTACGAC
ACCGTACTTGATGATGAAGCCATGAACCTATCGGTGGGTGAACGCCAGCTGATCACCATC
GCGCGTGCATTCTTGGCTAATCCCCGACTGCTGATTCTGGATGAAGCCACCTCATCGGTG
GATACGCGTACCGAATTGTTGATTCAGCGCGCCATGTCCAAGCTGCGCCAAGACCGCACC
GCCTTCGTCATCGCGCACCGGTTGTCCACGATTCGTGATGCCAACCTGATTTTGATGATG
AAAGACGGCGAGATCGTGGAGCAGGGCAATCACCGTGAGTTGATGGCCCTGGAGGGCGCA
TATTGGGAGTTGTATAACTCCCAATTCAACGCCCCCGCGAAAGAAGAATTACAGGCTGAC
GGAGATCAC >RXA00735-downstream
TGATGATTTCTTCTTAGGCTTTC >RXA00796-upstream
CTGGAATCCCAAAGCGCTTGCATGACGCGGAAAGTTAACATAGGCTAGGTACGTCAAGTT
GTTGATACATCAACTTAATTAACTTTTAGAGGAGTACACC >RXA00796
ATGAGCAAGATCGCCATCATCACCGGTTCCACCCGTCCAGGCCGCGTCAACATTGACGTA
GCCAACTGGGTTCTCGAGCGCGCACAAGAGCGCAACGATGCACAGTACGAGCTCGTTGAT
ATCGCCGATTTCAACTTCCCCGTCCTCGACGAAGCAATGCCAGCCGGCTACGGCCAGTAT
GCAAACGAGCACACCAAG >RXA00801-upstream
GGATAAGTTTGTTTCTGAGCGTATTGGTCTTGATGATGTTGAAGAGGCTTTCAACACCAT
GAAGGCTGGCGACGTGCTGCGTTCTGTGGTGGAGATCTAA >RXA00801
ATGGCTCACGACGGATTGCGCGTAGAAAACATTGTCACCTCAGGCATCTTTGCCCTTGAT
GGTGGCGAATGGGAAGTCGACAACAACATCTGGGTTGTGGGAAATGATGATGAGGTTTTC
ATCATCGATGCGGCACACACTGCAGCACCCATCATCGAGGCTGTCGGTGGACGTGCTGTG
AAGGGCATTTTGTGCACCCACGCACACAATGACCACATCACTGTCGCACCAGAGCTATCC
AAGGAATTTGATGCACCAATCTTCGTGCACCCAGGTGACCAAATGCTGTGGGAGGAAACC
CACGGAAACCTGACCCACGAGGATTTGGCAGATCAGCAGAAGTTCCAAATCGCTGGAACT
GAACTGATCGTGCTTAATACCCCTGGACACTCACCTGGATCCAGCTGCTTCTACCTCCCT
GAAGCAAACGAGCTCTTCTCTGGAGACACTTTGTTCCAGGGTGGGCCGGGAGCAACTGGC
CGTAAGTACAGCTCCTTTGACACCATCATTGAGTCCCTCAAGACCTCAATTTTGGATCTA
CCAGCGGAAACCACCGTGCGCACTGGCCATGGTGATCACACCAGTGTGGGGGCTGAGGCT
CCACACTTGGAGGAATGGATTAAACGCGGGCAC >RXA00801-downstream Appendix A, page 19

Atto Docket No.: BGI-125CP

TAAGCCCCGAACGATTAGTAGGC

>RXA00802-upstream
GCCATGGTGATCACACCAGTGTGGGGGCTGAGGCTCCACACTTGGAGGAATGGATTAAAC
GCGGGCACTAAGCCCCGAACGATTAGTAGGCTTGGGCACC >RXA00802
ATGGATCTTAAACTTGGTGGCCAAGTCATACTTGTTGTTGGCGGTGCAGGAACTATTGGT
TCTGAAGTTGTAAAACTCTTAACTGAAGAAGGCGCAACCGCGGTAGCGGCGTCGAGAAGC
ACGCCCTTATCTATTGACGCTTCGGATGAAGCGTCCGTCCGTGCGGGCATTGATCAGGTG
ATCGCAGAACATGGTCGCCTGGATGGGCTGGTTGTTTCTTCTGCACCCGCTGCGCAAACG
CTCAGCGCGGAGACAGCAGATGATCGGACACTGTGTTGGCTGCTATTGAAGGCAAAGCC
ATCACGTTTATGAAGGCTGCAACCGTGGCGCTCGAGAAGATGCGTGAGGCTGGACATGGG
CGCATCGTTGCACTTTCCGGCATGAACTCATACAAAACATTGAGTACTACTGCGTCGGCG
CGAAATGCTGCGCTGAATGTCGTGGTGAAAAATTTGGCGGATCGTCACGCGGGCACCGGA
ATTACAGTAAATGCGATTAGCCCGGGATTCGTGGTAGCTGAGCCAGACGCTGAGGTAAAC
CGCGCAAATGGTGACACCACGTGGAGGAGGTCGCGGAGGCGATCGCGTTTTTGTTGTCGC
CGCGCACCGCATCAATTTCTGGAGAGATTATTTCGGTGGGACATAAGGCGAAGGGCATCA
TCCTTCCTTAGCTCGCGTGAGCTTCCCAAGCGTAAGCACCCCGTGTGAGGGCA >RXA00802-downstream
TAACGGCCGTTCTGTTAAAGATT >RXA00819-upstream
TCTTCCGAACGGCCTGC >RXA00819
ATGGTTGGTGGCTCCCCGGAGCAGGCGCAGCGATTGGATGCGCAGATCAAATCTGGTGAG
GTCAAGGGCGTTTTTGCACTGACGGAACCTGATCATGGCTCTGATATCGCAGGTGGTCTG
GCAACCACGGCCACTAAGGACGCAGACACCGGCGAGTGGATTATCAATGGTGAAAAACGG
TGGATCGGTGGTGCTTCCACTGCTGATTTGATCGCTACCTTCGCCAGGGATACAGCCGAT
AACCAGGTGAAATGCTTCCTCGTGGCACCTCAGGCAGAGGGCGTGTCCATGGAGATTATT
GATCGCAAAGCCTCACTGCGCATCATGCAAAATGCACACATTACCTATAACAATGTCCGG
GTGTCTGGGGATGCGCGGCTGCACAACATCAATTCTTTCAAGGATGTTTCGGAATGCCTG
CGCCGTATGCGTTCCGATGTGGCGTGGATGGCCGTCGGTGCGCAGGCAGGTGCCTATGAA
GCAGCCGTGAAGTATGTGCGCAGCAGGGAACAGTTTGGCCGTCCGATCGCGGGGTTCCAG
TTGATTCAGGAAAAGCTCGCGCTCATGCTGGGCAATCTCACGGCGTCGCTGGGCATGATG
GTCAAACTCACCGATCAGCAGCAGGCGGGAATTTTCAAAGAGGAAAACTCCGCGCTGGCG
AAAATGTTTACCTCGCTCAAACTTCGGGAGACCGCTAGTTGGGCGCGGGAAATCTGCGGA
GGCAACGGCATCATTTTGGACAACGATGTTGCCCGGTTCCATGCCGATGCAGAAGCCGTC
TATTCATATGAAGGCACCCACGAAATCAATGCACTCATCGTTGGNCGNNCCATTCTGGGN
CNTCTNTTCTTTTTATATTATNACNCTTTTGAGGAGGATCTTCATGACTACTTCCACCAC
CCCAAACCATCGTTTCTTTCGAAGACGCACCAACCCTCACCGGCCAGGACCTGGGCTTTT
CGCAGTGGCGCACTGTCACCCAGGAGATGG >RXA00819-downstream
TGAACACCTTCGCGGACGCAACT >RXA00821-upstream
TTAAAAGCTTGCTTCTCGACGCAAAAACCCATCCGGCGCATCCCTTCAATGTTAGGGGTG
CGCTGCTATTTTTCTCCCCAGTTCTACGAAATGACTTATT >RXA00821
GTGACTAAGCTTGAGCGCATGGAGCATCCTGCTTACAGCCAATTGCGGCCGGTTACCCCG
TCCGCATCTGTTGTTTTGTGCCCTAATCCCGGTTACAGCTCGCTGGAAGGCACTAATTCT
TGGGTTATCCGGGCACCAGAAGACCCCCGGAGCATTGTCATCGATCCAGGTCCTGAAGAT
GAGGGCCACCTTAACGTCTTGCATTCCAAGGCTGAGGAGGTGGGTTTGATTCTTCTGACC
CACCGTCACTATGATCATGCTGACGGCGCACAGCGTTTCCGTCAGCTGACCAATGCACCT
GTGCGTGCGGATGGACCCTTCGTACTGTGCTGGTGCGGAGGAGATTCATGATGGTGAGATC
ATCACGATCGACGGTGTCACCCCACAGATTGAGGTGGTGGCCACACCTGGTCATACCCGT
GATTCTGTGTCTTATTTCATCTGGAGTGGAGTCCCTCATGAGTCCACTTTGGAGGGCATC Appendix A, page 20

```
GTTTCTGGCGACACCATTGCGGGTCGTCACACCACGATGATTTCAGAGACCGACGGCGAT
TTGGGTGAGTACCTGAATTCTTTGGCCATTTTGGAGGAGCGCGGCAAGGATATTCCGCTG
CTTCCAGGACATGGTCCAGATGGACAGGACGTGTCCTCCTTCGCGCGTAAGTACATTGAG
CGTCGTGAGCTGCGTCTGAACCAGATCCGTGAGGTATGGGAGACCCGTGGCCGTGACGTG
TCCATGAAGGATCTCATCGACGCCATCTACGATGATGTTGATCCAGTTCTGCGTGGTGCA
GCCGAGCAGTCCACTCATGTGGCTATTCGTTACCTGCAGGCTCAGGAAGCTTCCGCCCTCA
AAC

>RXA00821-downstream
TAAACACTTTTAACTAAACAACA

>RXA00827-upstream
TGCGTGAATTAACAGACAACGGAATCAGCATTGTGTCAGTAACCCATGATCCTGATTTCA
TCGCAGCGCTGGGCGATCACCACATTGAGGTGAGCGCGAA >RXA00827
GTGAACCTGCTGATCAAAATTAATCCCGTCACCCGCATCATCGCGTTGATGGTACTGACC
ACGCCGTTGCTGCTGAGTTTGGATGTGATGTCGGCAGCGATCGCGCTGGTGGCAACCATT
ATTCTGGCACCATTTGCCGGCGTGACCTGGAAGATGCTGCTGAAACGTGGCTGGATGCTG
TTCCTCATGGCACCGGTGGCCTGCATTATCCATGGCGCTTTATGGCAGGCCGGATGGAAAA
GAGTACTTTAGCTTCCTGCTCATTCACGTCACTGATAATTCACTGGCTTTGGCTGCTGCC
ATTGGGCTGCGTGTTCTGGCGATTGGTCTGCCCGTTGTGGTGCTGATTGCTCGCATTGAT
CCCACCGACCTGGGCGATGGTTTGGCGCAGCTGCTCAAACTGCCTGAAAGGTTTGTCATC
GGTGCTGTGGCAGGAAGCCGACTGATGACGCTTTTTCGGGAAGATTGGTACTCCATGTCC
AGGGCAAGGCGTGCCCGCGGAATTGCTGATCAGGGCAAGATCAAGCACTTTTTCACCATG
ACTTTTGGTTTGTTGGTGCTCTCGCTTCGCCGTGGATCCAAGCTTGCAACGGCGATGGAA
GCACGCGGTTTTGGTCGCACGACTGGCCGCACCTGGGCAAGGGAATCCACCGTCGGCGCG
CGCGATCTGGTGCTCATCTTGGTGTGTGCTGCCATTTCCGCGATCGCTCTAACCGTGTCC
ATTCAGACTGGTTTCTTTAAGTTCTTGGGCACA >RXA00827-downstream
TGATCACAGTTTTAATTGATGGA >RXA00842-upstream
CCTTGTCGCGGAGGTAAGCGAGGGTATTTCTGGATGTGGAACAACGCGGATTATGGAAAA
TCGTGACTTTCATAACGTTGAGCCTACTAAGGTTTGTTCC >RXA00842
ATGATTATTCAAATCCTAAGAGTGGCATTTGCCTTCGTCGGCATCATTGTTGGCGCCGGT
TTCGCATCAGGGCAAGAGGTCATGCAATATTTTGTGGCCTTCGGCATAGACGGAATTTGG
GGAGTCATTGTTTCTGCAGTGATCATGTCGGTGATGGCGTTGATCATTTGCAGCTCGGA
AGCTATTTCAATGCAGGTGAACACGGTGAAGTGTTCCGCCGAGTAAGTCACCCCGTTTTC
TCCAAAATTTTGGACATCGGCGTTGTGGTGACGTTGTTCTCCACCGGTTTCGTCATGTTT
GCAGGCGCGGGATCAAATCTGAATCAGCAGTGGGGGCTTCCGCTCTGGATCGGTTCTGTG
ATCATGGTTCTTCTGGTGCTGGCTGCGGGCATGTTGGACGTGGATAAAGTAACCACAGTC
ATTGGTGCAATTACTCCGTTCATCATCATTTTCATCACTGCCGCCTCGATCTACACGCTG
GTAGGTAATTTCAGCTCAGTGGAGCAGCTTGATTCTGCTGCTTTAGAAGTCGGCACGACG
TTGCCTCACTGGGCTGTTGCAGCGGTGAACTATGTGGGATTCAACCTGATGGTTGCGGTG
TCCATGGCTGTGGTCATTGGTGGATCAATGTTTAACCCGCGGGTCGCAGGTCGGGGCGGT
TTGCTGGGCGGATTGATCCTGGGATTCTTGATCATCATCAGTGCGCTAACACTGTTCGCC
ACCGTGGAAGAAGTTGGCCAAGATGATATGCCTATGCTGACGATCATCAACAATTTGAAC
CCGCTGGCTGGCCAAGTAATGGCAGTGGTTATCTACGGAATGATCTTCAACACGGCACTG
GGTATGTTCTACGCATTGGGCCGTCGTCTCACTGCGAAAAACCCACAGCGATTCCGTCCG
GTTTATGTGGTCACAGTGCTGATTGGTTTTGTGTTGAGCTTTGTGGGATTCAAGAACTTG
GTGGGCTATGTGTACCCAGTCTTGGGATACATTGGCCTGCTGCTGATTGCAGTGATGATG
GTGGCGTGGGTGAGGGGACGCGTACGCATCTACAAGGAATCCGAACGCCGCATGCGGATC
GCAGACTTGTTGCAGATCGGCATGACGGAGCTTGAGTGGAGCAGAGCTGGCGGTGCTC
AACCAGGAAATCCAAGATTCAAACTTGGATGAGGAACAAATTAAAGCAGCGGTTAGGAAG >RXA00842-downstream
TAGTTACTCTGCAGGGACGAGCT
```

Attorney Docket No.: BGI-125CP

>RXA00847-upstream
TCTGGCCCGCTGTGTCCTCTGGACGCAGCGGGCCAGTAGTATTTTGGGGGTGAGAATAAG
GTTTGGAATTCTAAGTGTTGTCGCCTGCACGGTTTCGTTG >RXA00847
GTGGCATGTCAGGCTAATCCGGGTCCTGCGCCCGTTGAGGAGCCAACTACAGCCACTGCG
ACGACCACGGCAACTGAGACGACCACCGTAGAGACTGAAGCCCCCAAACAAGATCGGGAA
ACCATCAGTATTGGTATCGATCCGATCCGCAACGGTTTCAATCCACATTTGTTGTCTGAT
GATTCTCCACTGGTGCGCGATACTGCATCGTTGGTGTTGCCGAGTGCTTTTGAGGGCAAT
CAGCTGAACACTGACTTGTTGGACAATGTTGAGCAGGTGGATGAAACCACGGTGAGGTAC
ACGATTGCTCAGGAAGCGCAGTGGAGTGATGGCACTCCGATTACTGGGTCTGATTTTGAG
TACTTGCGCAGGTCCATTGTGGCGGGGACAGGAACGCTGAACGATTCTGCATATTCGGCG
ATTTCAGAGATTAGGACCTCAGGCGGTGGAAAAACTGTCGACGTTATTTTTGAACATCCT
GTCGCTGATTGGCATTTGCTGTTTAACAATTTGTTGCCGAGTCATTTGATCACTGGCAAT
TCCACATTCCAGACAGCGTTTTATGATTCCATCCCGGCCTCTGCGGGGCGCTACATGGTG
CGTTCCATTGATCGTCAGCGCGGCGTGATTACGTTGTCGCGCAATGATCGTTTCTGGGGT
GCAAATCCGGCACACGTGGAAGTACTCCAATTCAACACCGTTGCCTCTGCATCCCGGGCG
GGGGAGTACCTGCGCACCGGGCAGAGTTCGTTTATGAATCTGTCACCGCAGGAAACCCTG
GTGGACACGTTGAATTTGGTGCCGGACACGGAAGTGCGGGTGTCTGACACGACGCGCACG
CTGGAGCTGGTATTCAACGCCGAAGCGCTGGCACCGGCGCAGCGCGCCTACCTGACATCG
CTTATCGACGTCCCCCTCACCGCCAAGTTAGCTGGCGGTCGCAGTGCAAACCTGGGTGTG
CCCCAAACGGTGGAGGCGAGCGTCGATAAGCAAGAAATTCCTGCGTTGCGCCTGGCGGCG
GACCCCGCCGACGATGCTGGTTTGGCAGCTGCGCGGGGCATCGTCGATATGCTGGCTGCG
GATGGAATCAAGGCTCAGGTCGTGACAACCGATTTGAATTCGGCGATTGCGGGTAATTTT
GATGCGATCGTGGCGTGGACCAGAACTGCCACGGATTCGATTGCGTTGGCGGACCGAGTG
GGTTGTGGCGTGAACTTGGCAAAGTGGTGCGCTGAGGGAACCACGGAATATATCAACGGT
GTTTTGGCGGGTGAGATTGATTTCGATCCTGCGTGGGAGCAGCAGTTTAACACCGAGAAT
CACTTGCGGGTTCCGATCCTGCGGGAGACTCGGGTAGAAGCGAAAAATAACGGTATCCTC
GGGGCTGCGGATGGCTGGCCTGGGGAATTTCAAGTGCTGCAAGTTGGAGGAAAAACGAT
GTTGAAGAA >RXA00847-downstream
TGATCTGTCTGGTGCTCGAGTTG >RXA00851-upstream
TTGAGCGGGTCATTTGCATCAATGATCATAAAATCGCTGCTGATGGCCCTCCGCAAAAGT
CCATTGACCTGTACGTATCGCTTATGGCGGAACCTGCGAA >RXA00851
ATGAACAGTATTCCTTTAGGTTTTTACGTCGATAAGCAATCTGTTGTTCATTCTTTTCCT
GCTTTGTGGAAATTCCCACTTCTGCTGTTTTTCATCATCGGCGGCTCCATCGCGGCTTCT
ACCCCGGTTCATGGGTTGATTTTGGTGGGGATTGCAGTGGTGTTTTACGTGCTGGCGAAG
ATTCCGCTGAAGGTCGCGTGGGAGCAGTTGTGGCCAGTGCTGCCGATTTTGATCATGCTC
GGTGCGTTTCAGTGGTGGCAGCGCGGCTTTGATTTCGCGGCAACCACAGTGCTCACGCTG
TTTTCCGCGGTGATGGCCGCCATGTTGTTGACGTTGACCACGCGGTTGGAAGCGCTCATG
AATGCAGTTGAGCGGATGTTGCAGCCTTTTGCACGTTTTGGCCTGCCAGTAGAGACGATC
ACCTTGGCTATTTCTCTCACGATTCGGCTCATTCCGCTGCAATTAGCCACGGTGAAGGAA
GTCCTCGATGCCCGTAAAGCTCGTGGTGCCGGTTTTTCTATCGCCGCGTTTGGCACGCCT
GTGATCATCAGATCAATAAAGAGGGCCCGCAATATCGGCGATGCTCTTCTCGCACGTGGT
GCCGGCGAT >RXA00851-downstream
TAATTTCTTTCAACACATAGCAA >RXA00852-upstream
AGATCACCGTCATGGTCATAATCGCCGCTGGAGTTCATGCAGCATTCCCTGACATCCGTA
AGAAATAGTTCCAACCCACTTTTCCTCAGAATTGCAGTTC

>RXA00852

Appendix A, page 22

ATGCCCGAGATCATTTTTGACAACACTGAAGTACGCTACGATGACTCGCTCATTTTAGAG
CCCCTATCGTTAAAACTGACAGAACAACGCATTGGCATCATCGGGGCTAACGGCGGTGGA
AAATCCACGCTCATCAGAATGATCAATGGTCTCGGCGAACCAACCACAGGGCGTGTTCTA
GTTGATGGCCTTGACGTCTCGCATTCCGGACGGGAAGTTCGCAAGAAGGTTGGATTTGTC
TTCTCTGACGCTGAAAACCAGATCGTGATGCCAACTGTGCGTGAGGATATTGCCTTCTCG
CTTCGCCGGCACAAAATGCCACGCGCTGAAAAGGCGCAACGTGTCGACGAGATGATGGCG
CGATTCAACTTGAGCGAGCATGCAGATCAATCACCGCACACCCTATCCGGTGGTCAAAAG
CAGTTGTTAGCGCTGGCTGCAGTACTGATTTTGGAGCCAGAAGTGATCATCGCTGATGAG
CCCACTACCCTGCTGGATCTGCGCAATAGGCTGATGATCAAAGACGTGTTCAATAAACTC
GAGCAGCAATTAATCGTTGTCAGCCATGATTTAGATTTCCTCAGCGATTTTGAGCGGGTC
ATTTGCATCAATGATCATAAAATCGCTGCTGATGGCCCTCCGCAAAAGTCCATTGACCTG
TACGTATCGCTTATGGCGGAACCTGCGAAA

>RXA00852-downstream
TGAACAGTATTCCTTTAGGTTTT

>RXA00856-upstream
GTTTTTAGGAATAGAGTGGGCTCAAGCTTTGTGACAAGTTTTTTGGAGAAATCATTACTA
GTCGTAGTCTTCAATTTGGGTGCAGGTAGGGTGGAACACC >RXA00856
GTGAGTGATGTATCAGCAGGCGTAAATGGCGCACAAGATCCAAGCAATCAAGCGGTCAAG
CCTTCCAACTGGAACCTTCCGAACTTCTTGACCAGCTTGCGTATCATTGTCATCCCTTTG
TTTGCGTGGCTTACGCTTAAAGGTGAGACGGAAAACAATGCTTTTGCCTGGTGGGCGTTG
GTTGTTTTCATTTGCTCATGATCACCGACAAGCTTGACGGCGATATTGCGCGAGCACGT
GGCCTGGTCACTGACTTTGGCAAGATCGCGGATCCGATTGCCGATAAGGCGTTGATGACC
ACAGCATTTGTCTGTTTCAACATCATCGGCATTTTGCCCTGGTGGGTCACTGCGTTGATT
GTGCTTCGAGAGTTCGGCATTACCATCTGGCGTTTCTTCCAACTGCGCGCTGGAAATGTT
GTGCCTGCATCAAAGGGGGGCAAGCTTAAGACTGCTCTGCAGACTGTTGCCGTTGCTCTG
TATCTGTGCCCTTTCCCAAGTTGGATGGATATTCCAAGCCAGATCGTCATGTATGCA >RXA00870-upstream
CAAGACGGCGATGTCGCCGCCGCTGTTGATACCGCAGCGCGACTTGTTCACACAGATATT
CAACAATTCACTTCGCAGAGCATTTAAGGAATTTACACAC >RXA00870
ATGTCTGAACCACACAAACCATCTCGCACTGGATTGACGGCGCGATTTCCCCATCCACTTCC
GGCAAGACCGCTCCTGTCTACAATCCTGCAACTGGCCAGGTCACCGCCAATGTTGCGCTG
GCTAGCCAGGAAGAGATCGATGCCACCATCGCTTCTGCCACCAAGGCTGCTAAGACGTGG
GGCAACCTGTCTATCGCTAAGCGCCAAGCTGTGCTTTTCAACTTCCGTGAGCTGCTGAAT
GCTCGCAAGGGTGAGCTGGCGGAGATCATCACTGCAGAGCACGGCAAGGTCTTGTCCGAT
GCCATGGGTGAAATCCTGCGCGGCCAGGAAGTCGTGGAGCTTGCTGCTACCGGTTTCCCACAC
CTGCTTAAAGGTGCGTTCAACGAGAACGTCTCCACCGGCATTGATGTGTATTCCTTGAAG
CAGCCACTGGGTGTTGTCGGTATCATCAGCCCGTTCAACTTCCCTGCGATGGTGCCGATG
TGGTTTTTCCCAATCGCAATCGCTGCAGGCAACGCAGTTATTTTGAAGCCTTCAGAGAAG
GATCCTTCGGCAGCGCTGTGGATGGCTCAGATCTGGAAGGAAGCTGGTCTTCCAGACGGC
GTATTCAACGTGCTCCAGGGCGACAAGCTGGCTGTTGATGGTTTGCTGAACAGCCCTGAT
GTCTCTGCGATTTCCTTCGTGGGTTCCACCCCAATCGCAAAGTACATCTACGAGACTTCC
GCGAAGAACGGCAAGCGCGTCCAGGCGTTGGGCGGCGCGAAGAACCACATGCTGGTGCTG
CCAGATGCTGATCTGGATCTGGTTGCCGATCAGGCAATCAACGCAGGTTACGGCGCTGCC
GGTGAGCGTTGCATGGCTGTTTCTGTGGTCTTGGCTATTGAATCTGTTGCCGACGAGCTC
ATTGAGAAGATCAAGGAGCGCATCGACACCCTGCGCATCGGCAACGGTGCCGGCGACGAG
CAGGGCGAGCCGCACCTGGGCCCACTAATCACCGACGTCCACCGCGACAAGGTCGCTTCT
TATGTCGACATCGCTGAGGCCGACGGCGCCAAGATCATCGTGGACGGGCGTAACTGCGCC
GTAGACGGGCACGAGGAGGGCTTCTTCTTCGGCCCTACGCTTATCGACGACATCCCACTC
ACGTTCCGCGCCTACACCGAAGAAATCTTCGGCCCGGTCCTCTCTGTCGTTCGTGTCGCA
TCCTTCGACGAGGCAATTGAGCTGATCAACTCCGGTGAATTCGGCAACGGAACCGCAATC
TTCACCAACGATGGTGGAGCGGCACGCCGCTTCCAGCATGAGATCGAAGTGGGCATGATC
GGCATCAACGTACCAATCCCAGTGCCTGTTGCGTACCACTCCTTCGGTGGTTGGAAGAAC
TCCCTCTTCGGTGACGCCAAGGCATATGGCACTCAAGGTTTTGATTTCTTCACCAGGGAA
AAGGCGATCACCAGCCGTTGGCTCGACCCAGCAACCCACGGTGGCATTAACCTCGGTTTC Attc Docket No.: BGI-125CP

CCACAGAACGAT

>RXA00870-downstream
TAATTGAAGGAGAGCACAGGACT

>RXA00875-upstream
CAATTTGGCGGCGCTGCTGGGTGATCGGGGGCCGGTTGTTCCGGGTGTGATTGGTGACTG
GGTGAGGGGCTAACGCAACAATGTGTCTAAGCTTAGGGGC >RXA00875
ATGACTACTGAGGTTGAACTGGTTGTTTTAGCTGATTCCGAGGGCAATCCTATTGGTACT
GCGCCCGAAAGCTACGGTGCACACTAAGGACACGCCTCTGCATTTCGCGTTTTCCACCTAT
ATTTTGAACCCGCGTGGGGAGCTGTTGGTGACGCGTCGTGCATTGTCGAAGAAGACATGG
CCTGGTGTGTGGACGAACTCTATGTGTGGGCACCCTGGTCCGGATGAGACAAACGCGGAT
GCGATTCGTCGCAGGGGTGTCGATGAGTTGGGGCTGGAGGTAGATTCTTTCTTGGATATT
CAAGAGATTCTGCCTGATTACCAGTACCGTGCTGTCGACGCGTCCGGCATTGTGGAGTGG
GAGTTGTGCCCGGTCCACCTCGTGCGTTTAGCGGTGGGGGAATTTGTGGAGCCACTGGAT
GATGAGGTGGAGGAGTTCGAGTGGGCGGAACCGCAGAAGCTTTTCGACGCTGTTGATGCC
ACACCATTTGTGTTTTCTCCATGGCTAGTGGATCAGCTTAGCGCCCCTGAGCTGCGCCAA
GCCATCCTGGAAGCGTTTGACGCAGAG >RXA00875-downstream
TAACTAACTAGTCTAGAAGCCTT >RXA00878-upstream
CGAGATTAGGTCCGCTTCAGTTGTGGTGGCTCCGAATCTGATGAACAATGATCATTCCTA
ATTCATTTACATCTTTATCAAAGAGAGCCACCACCTACTA >RXA00878
ATGCGACTTCTTGGTCGAATTTTAAAAACCACGTCTGCGCTTTGGCCCTACTATCTCGGA
ATTATCGTCGTATCCATTGTGATCGCGGCGTTGTCGCTGCTGTCGCCGTTTATTCTCCGC
GAAGCAACAGATTCCATTGTTTCTGCAGTAACCGGATCTAACACCGTCGATGCAGTTACT
CGCACTATTATTTTCTTAGCTTTAGCCCTGTTTGTCGCAAGCTTCCTCAATACGGTGATG
ACCAACATCGGTGGCTACATCGGTGATGTCATGGCATCTCGTATGCGCCAGATTCTGGCC
ACGCGCTATTACGCAAAGCTGTTGGCGCTGCCTCAGAAGTATTTTGATAATCAGGTCACC
GGCACCATCATCGCCCGCCTTGATCGATCAATCAACGGCATCACGCAGTTCATGCAGAGC
TTCTCCAACAACTTCTTCCCCATGCTCATCACCATGGTGGCAGTGCTGATTATTTCCGCG
ATTTTCTACTGGCCTCTGGCAATTCTGCTGGCCATGTTGTTTCCCGATTTACATGTGGCTG
ACGGCGTTGACATCGAAACGCTGGCAGAAATATGAGGGCGAGAAAAACCATGAAATCGAC
GTGGCTAACGGCCGCTTCGCTGAGGTTGTCGGCCAGGTCAAGGTTGTTAAATCATTCGTC
GCAGAGACCCGCGAGCTGGCTGATTTCGGTGGGCGTTACGGCAAAACAGTAGCGATTACC
CGGCCGCAATCCGGTTGGTGGCACCGCATGGATACTCTCCGTGGCGCGGCACTAAATATC
ATCTTCCTGGCCATTCACCTGCTGATTTTCTACCGCACCTTGCACGGCCATTTCACCATC
GGCGACATGGTCATGCTCATCCAGCTTGTCACCATGGCGCAGCAACCGGTGTACATGATG
AGCTACATCGTCGACTCCGCGCAGCGCGCCATCGCCGGCTCCCGCGACTACTTCGAGGTC
ATGGCGCAGCAGGTCGAGCCCACCGCCAATAAGGAGCTTGTCGACGCCACCCTCGCCTCA
GACACTCCACGCATCAGTGTGGGCACGCCCGCCCGCTGCCCGCTGGAGAACCAGCAGTG
GAATTCAAAAACGTCACCTTCGCCTACGAAGAAGGCAAGCCGGTTATTTCCGACGTGTCC
ATTACCGCCCGCCACGGCGAGCGCATCGCGTTGGTCGGTGAATCCGGCGGCGGTAAATCC
ACCCTGGTCAACCTTCTGTTAGGTCTGTACAAACCAAACAGCGGCAGCCTTGCAGTATGT
GGCGTGGATGTTAAAGATCTGACTTCCGAGGAACTTCGCGCATCCGTGGGTGTGGTCTTC
CAGGACGCCAGCTTGTTCTCTGGATCTATTGCAGAAAACATCGCCTACGGTCGCCCAGGT
GCCACCCGCGAAGAGATCATCGAAGTGGCTAAGAAAGCCAACGCACATGAGTTCATTTCC
GCCTTCCCTGAAGGATATGAAACCGTCGTCGGTGAACGCGGACTCAAACTTTCTGGTGGC
CAGAAGCAGCGCGTCTCTGTGGCACGGGCCATGCTTAAAGATGCCCCACTTCTTGTTCTC
GATGAAGCCACCTCTGCACTGGATACCAAGTCTGAGCAGGCAGTCCAAGCCGGTTTGGAA
CAGCTGATGGAAAACCGCACCACCTTAATGATCGCCCACCGCCTGTCCACCATCGCAGGC
GTCGATACCATCGTGACCATCCAAAACGGACGGGTTGAAGAGGTCGGATCTCCTACCGAG
CTCGCAGTCTCAGGCGGTATCTATTCCGAACTGCTGCGCCTGACCAACTCCACAGCAGAA
GCCGACCGGGAGCGTCTGCGCGCCTTTGGTTTCACTGGCGATGCACCAGCTGAAGAAGAG
GAC >RXA00878-downstream
TAGCCCCGCGAAAGAACAATCCC >RXA00880-upstream
TCCATGTGGTTAAAGATATGCCTAAAGATCTGACCAAAAACGTGACTAAAGACGTGACGA
CACAAGTACAGCCAAATTAAAGGAAAGGTTGAATTTGACC >RXA00880
ATGACTTCACCTAATACCCTGCAGGAATACACTGAACCTGCCAAGTACACCATCGGAGAA
TCTGAAACCTGCCTGACCGCCCTTCTAGATCAGATTAAGACTCGACCTTACGGAGTTTTG
TTCAGCAAGCCTGCCAACTATGAGTGGGTGAATGTAACTGCCAAAGAATTTCAGGACGAG
GTTTTTGCGGTTGCAAAAGGAATTATTTCAGTCGGCGTAGAGCAGGGAGACCGTGTCGCG
CTGCTGTCCAATACTCGCTATGAGTGGGCTGTGCTTGATTTCGCTATCTGGGCCGCTGGC
GCAGTGAGCGTGCCTATCTACAGCTCCTCTTCACTGTCCCAAATTGAGTGGATCATTGAG
GATTCCGGCGCTGTTTTGGCCATTACCGAAACCCCTGATCATACCGACTTGATGAAGAAC
CTGGTCATCGGTGAAGACGGAACTCCAGCGATTAAGGGTTCACCTTCCAAGCTGCCGCC
ATTCTAGAGATCAACTCTTCGGCGTTGGAGACCTTGAAGTTTGAGGGCCGCGAGCTTTCT
GATGAGCTGGTGTGGGAACGCATTCATGCAACCAAGGCCGCTGACCTGGCGTCTTTGGTG
TACACCTCTGGCACAACTGGTAGGCCGAAGGGCTGCGAGTTGTCCCACTACCACTGGTTG
GCTGAGGTCCGAGCGCTGATCACCAATGACATCGGAGCGATCGCGATGCCAGGTTCAAGG
TTGCTCACCTTCCTTCCTTTGGCGCACGTTCTTGCTCGCGCAGTGCACTTGGCCTTCGCT
GTCACCGGTGCAACCCAGTCCCACTGGTCTGATTTCAGCACCCTTACTTTGGAACTGCAG
CGTTCCCGCCCGAACCTGATTTGGGTGTTCCACGCGTGTTTGAAAAGGTCCGCAACGCC
GCTGCTGCTAATGCTGCTGACGGTGGCGCAATCAAGCGCATCATGTTTGAGCGTGCCGAA
AAGGCGGCCATTGAATACTCCATGGCTCTTGATACTGCAGAAGGCCCAAGCAAGTCCCAG
GTTATGGCACATAAAGCGTTTGACAAGCTGGTGTACTCCAAGATCCGTGCAGCTGTCGGT
GGCGATGTGCAGTACGCCATCACCGGTGGTTCAGCGATGGGGCAGGAGCTGCTGCACTTC
TTCCGCGGTGTGGGCATGACCATCTACGAAGGTTATGGTCTGACGGAATCTGCGGCTGCT
GCAGCGGTGGACTTCACTGATCAAAGATCGGCACTGTGGGTAAGCCGATGGGTGGCATG
ACCATCAAGATCAATGAAGATGGCGAAATCATGCTAAAAGGCGAGATGTTGTTCCAGGGA
TATTGGAACAACCCAGAAGCCACAGCAGAAGCCCTCCACGACGGTTGGTTCAACACCGGC
GATCTGGGTGAGCTGTTGGAGTCTGGACACCTGGTGATCACCGGACGTAAGAAAGATCTG
ATCGTGACCGCGGGCGGCAAGAACGTTTCCCCAGGACCCATGGAAGACATCATCCGCGCA
CACCCACTGGTCAGCCAGGCCATGGTGGTGGGCGATGGTAAACCATTCGTTGGCCTGCTG
GTGACCTTGGATCCAGATATGTTGAAGCGGTGGAAGCTGAACCACAACATTGCGGAATCC
CGCACGGTTTCTGAGATTGCTACTGATCCTGCACTGCGTGCGGAAATCCAGGATGCAGTC
AACAACGCTAATGCCACGGTGTCTCATTCAGAGGCGATCAAGCGGTTCTACATCCTTGAT
CGCGACCTGACCGAGGAAGCCGACGAGCTGACCCCAACGCTGAAGGTCAAGCGCAACGTT
GTTGTTCGCCGTTACGCAGACGCCATCGACCACATCTACAACCGA >RXA00880-downstream
TGAGTAACACAGAGACCCAATTT >RXA00899-upstream
TTTGCTGCTCCCCTACGTCGGACTCCCACTGTTCCTGCTTATGGGATCGCCATACATCAA
CCGGTGACGCCACCGCATCCAACAAGAAATCAACGACCTC >RXA00899
ATGGAAGACGTCCACGACGACGTCCCCGACATCCCCACCGGAATGGATGTCTCCGCGGAA
GTTGAATCTGTCATCAAACTCAACCGCCGCCTCACCCGCATGCCAGCAGTGACCGGCGGA
AACAACGGCTTCTACTCCGACTACCGTGAATCCCTCAAACGGATGACCGCCGCAATCGAC
GAAGCCGAAGAATACATCTACGTCGAGATCTACATCATGGCCTGGGATTCCTACACCCAA
CCATTCTTCGCAGCACTCGAACGAGCCCACAACCGCGGCGTCAAAGTCCGACTCCTTTTC
GACCACGTCGGCAGCTGGAAATACCCCGGCTACCACCGCCTCAAAAAAGAACTCAACCGC
ATGGGCTTCGCCTGGTACCTCATGCTCCCCCTCCAACCCTGGCGACGCCGCTTCCGCCGA
CCCGACCTGCGCAACCACCGCAAAATGCTCATCATCGACGGCCACACCGCATTCATGGGC
TCCCAAAATCTCATCGCCCCGAGTTACCTACAAAAGAAAAACATCAAACTCGGCCGCGAA
TGGAAAGACCTCATGGTCGAACTCACCGGCCCCATCGTCTCCTCCATGGAAATGATCTTC
GCCGGCGACTGGTACGTCGAATCCAACGAAGCCCTCGACATCCGCGACCACGCAGAAGCC
CACGGCTACATCGGCAACACTCAAAAAGACTCCGCCACCAACCTCGTGCAGCTCATCCCC

```
TCCGGCCCTGGTTACACCACAGAACCCAACCTGCGCATGTTCAACTCCATCGTTCACCAC
GCCAAAGAACGACTCATCTTGTGCAGCCCCTACTTCATCCCCGACGAATCCCTCCTCGAA
GCCGTCACCTCAGCCTGCTACCGCGGAGTAACCGTCGAACTATTCGTCTCTGAACAAGCC
GACCAATTCGCCATCGACCACGCCCAATCCTCCTACTACCAGGCACTCCTTGAAGCCGGC
GTGAAAATCTACCAATTCCCCAAACCCGACGTCCTCCACACCAAGTACATGATCGCCGAC
CCCGACGACACCACCGGCAACGAAGCCCTCGGAGTCCTCGGATCCTCCAACCTCGACATC
CGCAGCTTTGGCCTCAACTACGAAATCTCCCTGATGATCGCCAAAGGCAACCTCATCCAC
GAACTCAACGCCCTCACCGACCGTTACCGCACAGTAAGTTTCAAGCTCACCTTGGATAAG
TGGAACCAGCGCAGTTGGCGGCGCCGCTACGTGGACAATGTCATGCGTTTGACCTCGGCG
CTGCAG
```

>RXA00899-downstream
```
TAGTTTGGCGCGTTTGGAGTGCG
```

>RXA00902-upstream
```
TTGTTATTGGTTTGTTCACTCCCATGCAATGTACGATCGGTTCTAACGTCTACGGCAATT
GACACGTCAATTTAATTCAGGAAAGGGGTGGGGAGAATTT
```

>RXA00902
```
ATGTCTAGTGGTTTTGAATATGTTCAACATCCTCGACGAGCCCTCCCTCCGCCTATACCT
GAACGGAAAGGTCCTGCCGCAGCATTCCTGCCGGGAACTTTCCATCCCATTAATCCAAAG
AATATTGCAGCGAGCCACGATCAGGTGCTTCTATCTGGTTGGGGCAAATTTGTGCGTTGG
CTCTTGGTATTGTTGTCCATTTTGGTCATCATCATTGGCATCAACCTCATCTTGGACGGT
GTCTACGGATTTGGTACTTTTTCAACCACCCAGATGTACCAAGTTGCGAAAGATCCACTC
ATTGGTGTGCTGATCGGTATCTTGGCTACGGCCTTGGTGCAATCATCAACCACCACCACA
ACGTTGACGGTGACTGCAGTTGGTACGGGCATTGTGTCGGTGCCTGTGGCGATTCCGATC
ATTCTTGGCGCAAATATCGGTACGACGATCACCGCGATGCTCGTTGCGTTTTCTTATGTG
GGTGAACGCAGGGAGTTTAAGCGAGCTTTTACGGTTGCCGCCATGCATGTGTGGTTTAAC
GTGCTCGTCATTCTTGTTCTATTTGTTGTGGAATTGCTCTTTCATCCATTCCGCACAATT
AGTGGTGCGATCGCAACGGAGATCACACTGACAACTGGTGGCTCTTTGCCTACCAGTGGT
GTGATGACCAAGATTTTTGATCCCCAACCCAACTTCTGGGTATGAATGGTCTTATCGGT
TCGATCGGCAATCCTAGTATTTCGGCGATTGTATGTCTTGTGGTGGGCACCATTCTTATT
CTGATTTCGGTGCGTGCCATGAGTTCTCAGATCCGAACCATTACGGCAGCGACCGTAACC
TCAATTATGGACAAGGTGATCAATCCAGAGAACAGCCCCAAGGCGACGATTCTTTCCAAT
TTCTGGAGCTTCATTCTTGGAGTTTTGTTCACGCTCATGGTCACTGCCTCGTCAGTGACC
GTGGCTTCCATGCAGCCAGTGGCTGCCTCTGGTGTCGTTAAGCAAAAGCCATTGCTGGGC
GTCATTTTGGGTGCCAACGTGGGCACCACGGTGACCGCAATGTTTGCTACTTTCGCGATT
GTCAGCGATCAGGGTGAGTTCGCTATTCAGGCTGCGTTGATCCACCTCATTGTGAACTTC
ACCGGCGCATTACTAGTGCTGTGTATTCCGCAGCTTGCCAATGTGATTATTCACTTGGCC
GAGAAAACTGCGAACCTCACTGCCCGCAGTTAC
```

>RXA00931-upstream
```
CCGTAACCTAATCGTTGAAACATCACCTTATTGCTGGGCTTTGCACGCTACTCTTTGTGA
GTAACCTCACCGAAGTGCATAAATTAATTGGGAGTGATCA
```

>RXA00931
```
GTGAAAACTATTGAAGATATTTTGACCTTGGAAGAAATCGACCGCGATATTTACCGTGGT
CCCGTTATCGAATCTTATTTAGCCAGGACTTTCGGTGGCCAGGTCGCTGCCCAAGCTTTA
GTAGCAGCAACGCATACTGTTGATAAAGCCTTTACTGTGCATTCTTTGCATGGCTACTTT
ATAGCTCCTGGTGATCCAACAGCACCCGCAATTTATTTAGTGGATCGAGTTCGCGACGGA
AAAAGCTACGTCACCCGCTCGGTGCGTGGCATCCAAGACGGCGAAGTAATCTTCAGCATG
CAGGCCAGCTTTCATCGTGGGGATGAAGGCATTGAGCACATGGACAAGATGCGTAAAGTT
CCAGCTCCTGATGAGATCAAGGGAACAGTAGAACGTATGCCGATCTCAAGTAGGCGAGTG
CTTGATGAATGGCGGAATGGATATCCGCGTTATTCCGCAGGATCAATTAGAACTCAGC
GATTTCACCGCTACTGAGCAAGCTGTGTGGATTCGGTGCACCGCTGATCTTCCGGATAAT
CCCACCTTCCACCAGTGCTCACTGACTTATCTGTCCGATATGACTTTGCTGCATAGTGCC
CTGGTGCCACACCCAGGTGAGAAAATGCAGATGGCCTCACTTGATCACGCTGTGTGGTTC
CTGCGTCCCTTCCGCGTCGATGAATGGTTGCTTTATGATCAGCGCTCTCCATCGGCCTCA
AGTGGGCGAGCCTTGACTCACGGGCGGCTTTTCAACCAGCAGGGAGATTTGGTCGCTATT
GTCAATCAAGAGGGAATGACCCGCACACTCCACGAGGGTGCGCAATCAATTCCGATGCGC
AAAGAC
```

Appendix A, page 26

>RXA00931-downstream
TAAAATGCAGCGAACTTGAAGAT

>RXA00941-upstream
AGCCGGGGTGGCCGTTTGCGTGTACGGGTTTTGCTTATCGACGCCCACTTCTGATTTTAA
AGGCAAATATTTTGTGTCACAGCGAGTAATCTTTTCGGGC >RXA00941
ATGAACCTAACCCGGAATGACAGGCTCGATCGACTGCCCGTAACTTCCAAACATAAAAAG
ATTCTTGGCGGCTCAGGTATCGGCTGGGCATTGGATGCCATGGATGTCGGACTGATCTCT
TTCGTCATGGCTGCGTTGGCCACTCATTGGGGCCTATCCCCTACTGAAACTTCCCTGCTC
GGATCCATCGGTTTCGTTGGCATGGCCATCGGCGCTTCGCTGGGCGGTTTGCTGGCGGAC
AAGTTGGGGCGTCGACAAGTTTTTGCGTTGTCTTTGCTAGTTTATGGCGTTGCCACTGGC
GCGTCGGCGCTTTCAGTGTCGCTGGCAATGTTGATGGCGCTGCGCTTCGTCGTTGGACTT
GGCCTGGGCGCTGAACTCCCCGTTGCATCCACTCTGATTTCCGAGTTTTCTCCACGAAAA
GTTCGTGGCCGCATGGTCGTTATCCTGGAGGCGTTTTGGGCGCTGGGCTGGATCATGGCT
GCAATCGTCGGAACCTTTGTCGTGGCAGGATCCGATAATGGTTGGCGTTGGGCGTTAGCT
CTTGGCTGTGTCCCTGCAATTTACGCGGTGTATGTCCGTCTCGGACTTCCAGAATCAGTA
CGTTTCCTGGAGAAGAAAGGCCGGCACGACGAAGCAGAAGCCATCGTTGTTTCCTTCGAA
GAAGCTGCCGCTGCCGAAGGTAAAGCTGCCGATGCCACCACCGCTGTGGTTCATGACAAC
GCTGCCGAGGGTTCCGTATCCATCTGGTCAGCTGCTTTGCGCAAGCGCACCGTCGCGCTG
TGGATCGTGTGGTTCTGCATCAACTTGTCCTACTACGGAGCCTTCATTTGGATTCCATCG
CTGCTGGTTGCCGACGGTTTCACCCTCGTGAAGTCTTTCCAATTCACTCTGATCATCACC
TTGGCTCAGCTTCCAGGCTATGCGGTTGCAGCGTGGTTGATTGAAAAGTGGGGCCGTCGC
AGCACATTGGCCACGTTCCTGGTTGGTTCTGCTATCTCTGCAGCGCTCTACGGCTTGGCA
AATGTGGAGTGGCAGATCCTGGTCGCAGGTTGTTTACTATCCTTCTTCAACCTGGGCGCA
TGGGGCGCACTGTATGCCATTGGGCCGGAGCTTTATCCCACTAATGTCCGTGGAACTGGA
ACGGGTGCTGCCGCGGGATTCGGGCGCATTGCTTCCATCATCGCTCCGCTCATTGTTCCG
CCAGTGATTGCTTTTGGTGGACCAATTGCTTTGTTCGCTCTCTTTGCCACCGCGTTTGCG
ATCGCAGCGATTGCGGCGTTTACGCTGCCTGAGCAGAAGGGTAAGTCTCTCGCTGAT >RXA00941-downstream
TAGTGAGATCCTTCCACCAGTTT >RXA00962
GATAAGGCCATCAAGGCGGATCACGACATTAGAGAAGGCCACGATGAGCCAGCAGGTTTC
AAGGATCTGCTTGTCGATCGCTACCGCTGGATCTCCATTTGGTTCGCGCTCGCCACATTT
GTCACCCTGCTCGCGTGGTACGGACTGGGCACATGGTTGCCTCGCCTCATGGAAACTGCA
GGTTATGAGTTCGGCCATGCATTGATGTTCACCCTGGCTCTGAACCTCGGTGCAGTGATC
GGATCCGTGGTTACTGCGTGGGCCGGCATCGCTTCGGGCCAATCCGTTCCGGTGTCATC
GCTGCAGGTATCGCCGGTATTGCACTGCTCCTGCTGCTCACTTACCCGCCTGTCACCGCG
GTTTATGTCATTCTCATTTTGGCTGGCGTGGGCACCCACGGCACTCAGATCCTCATCATT
GCAGCTGTCGCCAACTTCTACCCAAGCAACCTGCGTGGCACAGCACTGGGCTGGGCGCTA
GGTGTAGGTCGTATTGGTGCTGTTGTGGCCCCGCAGCTCGCTGGCCTGCTGCTGGCATGG
AACTTGGGCGTGAACTCCAACTTCATCATGTTCGGCACCGCTGCGCTGCTCTCTGCGCTG
GCTCTCAGCGTGTTGCTGCGCCTGCAGAAAACCTACAGCGTCACCCACAAAGTCGAAATC
CAAGGC >RXA00962-downstream
TAACCCCCTTTTTCAACTCACAG >RXA01060-upstream
TTCCATTTACACATCTGTTCGACTCGCGCCCGAATGATGTCGCATCAACATGAGAAGCTA
CTTCCATACTTTTACTGATTGATAAGAATGGACAAAGACA >RXA01060
ATGAACCGCACACTCCGAACACTTGGCTGGCTTGCTGCCGTAATTCAAGAAGATCCGGAG
CCCTGGTTCACCACTGATCCCGACACCGATTATGTCCCTTATGTAAATAGTTTCTCATTT
GAATCCCTTTCCCTCGTTCCAGATGCTCTGATGCTGCTCAAACGTTCTCTTCACCTTGCG
ATGGAGCAACAGGACCTCCCAGTGAAGGATCTACAAGAAGCACTGAGGCACGTACTAGTT

```
TTCAAATTCCACTTCAGGGAAGAATGGGAGCTGGAATTAGCATGGGACTCCGAGCGGACC
AAGTCTGCGGTGAGAATTATTGAGAGCACAAAAGAATCTCTTGCCGATCAATACAGAGAT
TACAAATACGCATTCTTGCCTGAGCTAATTTTCCAGGAATCACGCGGGATCTTTGACTTT
GAGCTGGAGGGATACACCCTCAAAGTAGGACAAAGCACGCTTTCCATTCCTTGGGACATG
ATCGCCAATGGTTATGTCCCTGCAAGTCTTCGGAATTTTGGAGAATTAATGGACCGTGAC
ACCGGAGATCTTGATGCAGATCCCATTCTGAGACCTCGAGAACTCAAATTTGAGATCCAT
AATTGTCCAGATCTTAATCCTTGGATAATGCGGGAAACTTTTGATTTCATGATGGAAATC
GCAACTGAAACAGGATGGTTCCATGCTCTCAACCCCGCATATAATTCCGTCTACACCTAC
GATCTTATTTCTCGCATGCCAGATTTCCTTGTTGAAGGGAGCTTTCGTCCGCATTCAGTG
AAACGATCTTGGGAAAAAATTCAAAAGATAGCTAAAGCTGTTGAGTCTTATGCATCTCAC
GATTACTGCATGTCAACGCTGACACATGACTACAGGGCAATCGAGTTATCCCTGACGCCT
ACAAAAACTGAGGAACCAAGCACA

>RXA01060-downstream
TAAGAAAACCTCGCCTGCCCACT

>RXA01067-upstream
GGCTTTAAGGCCGAGGTGCCTGGCTGAACTGCAGCCCCTCCAGACCCTGAGATCAGGCTA
AATGGCAAACACAAATAGTTTGCATGGCAGAATAGCTTAG >RXA01067
GTGAGTGAATTCCAAGTACCCGAAATCCCTGCCCAATTCCTACCCAAGCATATTGCGCTT
GTCATGGATGGAAATGGACGCTGGGCTACCGAGCGTGGCATGAAGCGCACCGAAGGCCAT
AAGCGTGGCGAGGCAGTCCTGCTTGATGTTGTTGATGCATGCATTGAACTTGGTGTTCCG
TACCTTTCTGCTTATGCCTTCTCTACTGAAAACTGGCGTCGTTCCACCGATGAGGTCCGT
TTCCTCATGGGATTCAACCGAGATGTGCTGCGACGACAACGCGATGACCTACATGAAAAG
GGCGTTCGTGTGCGTTGGGTTGGCCGTCGTCCCCGCCTGTGGCGTTCGGTTATCCGTGAG
CTGGAAACTGCGGAAGAGCTAACCAAAGACAACACCACCATGACCTTGGCCATGTGTGTG
AACTATGGTGGACGCGCCGAAATCATCGACGCAGCCCGCGACATCGCCCGCCTTGCAGCT
GAAGGCAAACTGCGCCCGGAACAAATCACTGAGAAGACCTTCCCGAACTTCCTCGACGAA
CCTGACATGCCAGACGTCGACCTGTTCCTGCGCCCATCCGGTGAGAAGCGCACGTCAAAC
TTCCTGCTGTGGCAGTCTGCCTACGCGGAAATGGTCTACCAAGACAAGCTGTTCCCTGAT
TTCACGCAGCAAGATCTGTACGACGCGGTCCTGGAATACGCCAAGCGGGATCGCAGATTC
GGAAGCGCA >RXA01067-downstream
TAATGCCCACCAACCAGCCGACG >RXA01114
CGCCTTGCAGAAGCACGCGAAACCGCTGGCGGACGCAACCACCCGATCCCTGGTGGCATG
ATCGAGACCGCTGAGAACCTGCGTCGCGAATACGGCATCTCCCGCGAGGAGCAGGACAAG
ATCTCCGCAGCGTCCCAGCAGCGTTGGGGCAAGGCTGCTGATGCGGGGCTTTTCGACGAC
GAGATCGTGCCAGTCACCGTCCCTGCCAAGAAGCGCGGCCAGGAGCCAACCATCGTTTCT
CGAGACGAGCATGGTCGACCAGGAACAACCGTCGAAAAGCTTGCTGCTTTGCGCCCCATC
ATGGGCCGCCAGGATGCGGAAGCAACCGTCACCGCTGGCAACGCGTCCGGCCAAAATGAT
GGCGCTGCTGCCGTCATCGTGACCACTCGCGCCAAGGCCGAGGAGAAGGGCCTGCGCCCA
GTCATGCGTTTGGCTGGCTGGTCTGTGGCTGCTGTTCCCCAGAGACCATGGGTATTGGA
CCTGTTCCTGCCACCAAGAAGGTCCTGGATCGTTTGGGCCTTACCCTGGAGGACATCGGC
GCGATCGAACTCAACGAAGCTTTCGCAGCTCAGGCACTGTCTGTGCTGAAGGAATGGAAC
ATTTCTTGGGAAGATGAGCGCGTCAACCCACTGGGTTCCGGTATTTCCATGGGACACCCA
GTCGGTGCCACCGGTGCTCGCATGGCAGTAACCTTGGCTCACCGCATGCAGCGTGAAAAC
ACTCAGTACGGACTGGCCACCATGTGCATCGGTGGCGGCCAGGGTCTTGCAGCTGTCTTT
GAAAAGGAGAAC >RXA01114-downstream
TAAAAATGGCTATTTTGCACAGC >RXA01136-upstream
CCCTCGCAACACCGACGGTAGCCTCTTGGAAATGGCGCGCATCGTGCGTGAGCTTTCCCG
CTAGGACCTGTCTACTGCCTTCACTTTGTGCGAACACCGC
```

Att'v Docket No.: BGI-125CP

>RXA01136
ATGACCTTGGATTACTTCAAGGCATCCGGCACTGACTATGCTTTGGGATTGGCTGCAGAG
TCGGAAGGGGCACGACGCACTGGTATCACCGGCATGGCGAGTGCATTCAAGGAGTTTGCT
GGTTGTGGTGAGATCGACCTTGAAGCAACCAGGGTAGAAGGTGGCCTCAAAGTTAGTGGA
AAGCTTCGTTGGGCTTCCAACTTGTGCGAAGATCCAGTGATTGTGCCTGCTGCAAAGACC
GCAGAGGGCTTACAACTACTGTTCGCATTGGGCGCAGAAACCGAAGGTGTCACCCTCGGT
TCTTCACTTGCTCTACTCGGTTTGAACGCAACTGCTTGCGCTTGGGTGAGCTTTGAGGAT
GTCTTCATTCCTGGGGCTCAGATTCTAAGCCACGATTTCCTTACCTTGTGGCATCGGTGC
GCCCAACCTTCG

>RXA01136-downstream
TGATCCTACGGATCTCCGAATAC

>RXA01138-upstream
CTTATTCAAGTTTTTGGAAAGATAATTAACTATGACTTTAAAAACAGTAAACGGAACGCA
GCTGCGAGACACTGTCGGATCGTTCCCTTCAGGTGTCACG >RXA01138
GTGGTCACCACTACCGATGGGGAAGTGGACCACGGGTTGACTGTGAGTGCGTTCGTGTCC
TTGTCGTTGGAGCCTGCCATGGTGTTGGTGAGTATCGATAAGAAATCAAGCGTTGTGCCG
TTTTTGGAGCAGGGTTCACCAGTTGCTGTGTCTGTGTTATCGGAAGAGCAGAGCGATTTG
GCCATCACATTTGGCCGTCATCTGGAAAACAAATTCGACGGCGTTTCCATTAAGCGTTCA
ACAAACAGGGCAGCGGTCTTGGAAGGTGCGTCAGCATGGTTGAGTGGCGCTGTGGTGGAT
AAATACCCAGGTGGAGATCACTTTATTATCACCATTGCCGTGGAAGAGTGTGCTCACGAC
GAGGAGCAAAAGCCACTTCTTTACCACCGTGGCAGGCTTTTTCAGTGGCAAGAAGAT >RXA01138-downstream
TAATTCTCCACCCCTTCATTTTC >RXA01172-upstream
TAAATTTTTCTAGACTACCCAGATTAAGTGAGATTCTTTCGTGTCTTCGACAACTTCGAC
AACTTCGGCCACCCGACAAGAGCCGTTGAGCCCGACGGGT >RXA01172
GTGCTTGCCTCGTTTAGGTTCGCGTTTAGTAGCCCGCGGAGGTTTCGCACCGAGGTTTTA
GCTGGCCTCGTGGTGGCGCTCGCGCTGATTCCGGAGTCGATTGCGTTTTCCGTATTAGCT
GGCGTGGATCCTAAGATGGGTCTTTTTGCGTCGTGCACCATGGCAATGACCATTGCGCTT
ACAGGTGGACGCCCTGCGATGATTTCCGCGGCGACAGGCGCTGTGGCGCTGGTGATTGCA
CCGGTGGTTCGGGATCATGGCGTGGAATATTTCCTGGCCACGGTAATTTTGGCGGGCATT
ATTCAGATTGCGTTGTCGTTGCTGGGTGTAGCCAAGCTGATGCGGTTCATTCCGCGTTCC
GTTATGCTCGGATTTGTTAATGCGCTGGCGTGCTTGGTGTTTTTTGCGCAGCTGCCGCAC
CTGATCGATGTTCCGTGGATGGTGTATCCGCTGTTCGCGCTGGGTATTGGCATCATGCTG
TTTTGGCCGAAGCTGACCTCGGTGATTCCGGCTCCGCTGATTGTTATCGTGGCCTTGACT
GCGATCGTGTGGGTTTTCGGAATCAACATTCCAAACGTCTCTGACCAGGGCGAACTCCCC
TCTTCCCTACCAGAATTCCTCATTCCCAACGTTCCGCTTACTCTTGAGACTCTAAAAATT
ATTGGGCCGTATGCGCTTGGAATGTCGCTTGTTGGGTTGATGGAATCGCTGCTGACCGCC
AAGCTGGTCGATGATATTACGGAGGTTCACTCCAATAAATCCCGCGAAGCTGCAGGTCAG
GGCATCGCAAACATTATCACCGCGTTTTTGGGCGGCATGGGTGGCTGCGCGATGATCGGC
CAGACCATGATCAACGTGAAAAACTCAGGAGCCCGCACTCGCCTATCCACCTTCTTGGCC
GGCGGCTTCCTGCTGCTCCTGGTGGTTTTGCTGGGCGATGTCGTGGGCAAAATCCCCATG
GCGGCGCTCGTGGCAGTCATGATTATCGTCTCCATCGACACCGCCGACTGGCATTCGCTG
AACCCGCGCACCCTCAAATTCATGCCGCTGAGTGAAACGATCGTCATGTTTATAACGATC
ATCGCGACCCTCGTCACCGGAAACCTGGCGATCGGCGTCATCCTCGGAGTGCTCACCGCC
ATGGTCATGTTTGCTCGCCGCGTGGCCCACCTCGTGTCTGTGGAGCGCACCAACGACAAC
AACATCAGCACCTATACCGTCAAGGGCCAGCTATTTTGGGCGTCCTCGAACGATATGGTG
TACTCCTTCGACTACTCCGACGAGGCCGAGCAGATCATCATCGATCTCACCGCCGCAGAA
ATCTGGGACGCCTCCACGGTAGCCACGCTGGACAGCATCATCCACAAATACGCCGCGCGC
GGCAAGAGCGTGGAGATCATCGGGCTCGACGGCCCCAGCCGCGATAGGCTTGAGCGCCTA
TCAGGCAAGCTGGGC >RXA01172-downstream Appendix A, page 29

Att  Docket No.: BGI-125CP

```
TAAAAATTTGCTTATCGACGCGC

>RXA01191
GTGAGTTTGGATGCGAACACGATTGAAACGGCGGGGCGCGGCGACGTGATTTCGCGTATC
GCGGATGATTCGCGGGAGGTGTCCACTGCGGCGAGCACCGTGGTGCCGCTGATGGTGCAG
GCGGGCTTTACCGTGGTGATTTCCGCGTTTGGCATGGCGGCGGTTGATTGGCGCCTCGGC
CTTGTCGGTTTGGTCGCGATCCCGCTGTATTGGACCACGTTGCGCGTCTATTTACCCCGC
TCAGGTCCGCTTTATACGCGTGAGCGCGAGGCCTTTGGGGTGCGCACGCAGCGGCTTGTC
GGCGCAGTCGAAGGCGCGGAAACCTTGCGCGCTTTCCGCGCAGAAGATACAGAATTAAAG
CGTATCGACGCAGCCTCCGGCGAAGCCCGCGACATTTCCATTTCTGTTTTCAGGTTCCTC
ACATGGGCATTTTCCCGCAACAACCGCGCGGAATGCATCACCCTCGTGCTCATCTTGGGC
ACCGGCTTTTACCTGGTCAACATCGATCTGGTCACCGTCGGCGCAGTCTCAACCGCCGCA
CTGATCTTCCACCGACTCTTCGGTCCAATCGGCACGCTCGTGGGCATGTTCTCCGACATC
CAATCCGCCAGCGCATCGCTGATCCGCATGGTGGGCGTTATTAACGCGGCATCGAACCAG
GTCAGCGGCACCTCGCCGGCGTCTGCCAGCACCGCTTTAACGCTTTTCGACGTCTCCCAC
CACTATCACACTGCACCCGTCATCAAGAATGCATCCGTGCAGCTGGAACCAGGGGAACAC
ATCGCCATTGTGGGTGCGACCGGCGCTGGTAAAAGCACGCTCGCCCTCATTGCGGCAGGC
CTGCTCAGCCCAACTTCCGGGCAGGTGGCTCTCGGCGGATCGAGTTTTTCTAACGTCGAA
CCGGAAGCATTGCGCCAGAAGATCGCGATGGTCAGCCAAGAAATCCACTGCTTCCGAGGA
TCTGTTTTAGATAATCTTCGTATCGCACGCCCCGAAGCCACCGATGCGGACATCCACGCC
GTTCTCGCCGATATTGGTGATTCCTGGTTGGAGCGCTTACCGCAAGGCATAGACACCATC
GTGGGTGATGGCGCTTTCCGTTTAACCTCTGTGGAAAACCAGATCATGGCGCTTGCTCGC
GTACATTTGGCCGACCTAGCAATCGTCATCCTTGATGAAGCAACGGCTGAATCAGGCTCT
GATCATGCAAAACAGCTTGAAGATGCAGCCCTTAAAGTCACTGAAAACAGATCAGCCATC
ATCGTGGCTCACCGCCTCAACCAAGCGAAAACCGCCGATCGCATCATCGTCATGGACTCC
GGAGAAATCATAGAATCTGGAACCCATGAAGAGCTTCGAGCGATCGGCGGTCGATATGAA
CAACTGTGGACTGCGTGGTCTGCGCGC

>RXA01191-downstream
TAATTAGCCACCCAAGACCACGC

>RXA01205
GTATCGGCCTATCCGCCGGCCATCATCGCAGCGGCTCTCGTAGGAATTTGCGCGGGAGTT
TTGCCCCATAATTTTGAACCCTCGCGAATATTTATGGGCGATTCCGGCTCCATGCTCATC
GGCCTGCTGTTGGCTGCAGCATCGACCTCAGCGTCAGGAAAAATCAACATGAGCCTGTAT
GGCGCAGCTGATTTTATCGCATTGATCTCACCCATCATCGTTGTTCTCGCCGCCGTGGCC
ATCCCACTGCTCGACCTCGTGATGGCAGTGGTTAGGCGCGTGGGCAGGGGAGCATCACCC
TTTTCCCCGGACAAAATGCATCTGCACCACCGACTGCTGTCCATCGGACACACCCATAGG
CGCGTGGTCCTAGTGCTCTACACCTGGGCGAGCGCCGTGGCATTCGGCGCAGTGAGCTTC
TCCGTCGTTCCGCCACTGTTTGCCACCGGATCGAGCATCTGTGGCATCCTCATCGCCGTC
GCTGTCACAGCCGTGCCAGTGATGAAAAGCCGGCGAGCCGCCAAACTTGAT

>RXA01205-downstream
TAAGTGATTGTCACTTTGGATTG

>RXA01212
GGCCTGAATTTCCATGTACAGCGCGGTGAAGTATTTGGTCTGCTCGGCACCAACGGGGCC
GGCAAAACCTCCACCTTGGAAGTCATCGAAGGACTTTCCGCACCCAGCTCCGGCACCGTG
CGCATCTCCGGGCTTGACCCCGTTGCCGACCGGCGATCCTGCGCCCCGAGCTCGGCATC
ATGCTGCAATCAGGCGGCCTGCCATCACAGCTCACCGTCGCCGAAACCATGGACATGTGG
CACGGCACCTGCACGTATCCGCGCGCCATTAAAGATGTGCTTGCCGACGTCGACCTCCTA
CACCGCGAAAACGTCAAGGTCGGCGCGCTTTCCGGAGGCGAACAACGACGCCTTGATTTG
GCCTGCGCACTGCTTGGCGACCCCTCAATTTTGTTCCTCGACGAACCCACCACCGGCCTC
GACCCAGAATCTAGGCGCCACACCTGGCAACTCCTGCTGGACCTGAAACAGCGCGGCGTC
ACCATGATGCTGACCACCCACTACCTGGAGGAAGCCGAATTCCTCTGCGACCGGATTGCC
ATCATGAACGCCGGTGAGATCGCAGTGGAAGGCACCTTGGATGAACTGGTGGCCCGCGAG
AAGTCGATCATCAGTTTCGTGCTGCGTGGCGGGCAGGTGGAGTTGCCGGTCTTGAGTGGG
GCTGAAATCATCCGCGACAACAACCACGTCCGCATCGCCACCACCACCCTGCAGCAGCAC
ACCTTAGAAATACTTACCTGGGCTGCAGAGACCGGGATCGCGCTGGAAGGCTTCGCTGCA
AAACCCGCCACCTTGGAATCCGTATTCATGGAC
```

Appendix A, page 30

Attorney Docket No.: BGI-125CP

>RXA01219-upstream
CACCATTTGGGAAACCGATTCCCCAGTTGATCCGGACCCATACTTGTCTTCCTATGACTG
GGCCAAGACCACCGCTGCGACTTCCTAAGAGATAAAAATC >RXA01219
ATGGACATTTTACTCAATCAGCTCGTAGCCGGGCTTTCAGTTGGATCGGTCCTTCTATTG
GTCGCAGTGGGATTGTCACTGACCTTTGGACAGATGGGCGTTATTAATATGGCGCACGGA
GAGTTCATCATGGTCGGCGCATACACCGCATATGTGGTGCAGCTGGTCGTCGGTTCTGCC
GGTTTATCCCTACTGATCAGCATTCCGCTGGCCTTTATTATCGGTGGGCTTTTCGGAGTT
CTCCTCGAACAATTCCTGCTGAAGTATCTTTATCACAGGCCACTAGACACGCTGCTGGCC
ACATTCGGTGTCGGTTTGATCCTTCAGCAGCTGGCCCGAAACATTTTCGGAGCTCCCGCA
GTGGATGTCAGGGCACCGGAATTTCTCCGCGGAAACGTCGAAGTTCTAGGCGTCTTGGTG
CCGACCGCGCGACTATTCATCCTGGCGCTGGCCATCGCATCAGTGACTGCACTAGCTGTG
TTCCTAAATCGCACTGCCTGGGGCCGACGCATCCGCGCCGTGGTTCTGAACCGCGACCTC
GCGGAAACCGCAGGTATTGATACCCGAGCTACTGACCGAATGACGTTCTTTGTGGGCTCC
GGTCTTGCCGGAATCGCCGGGGTAGCTATCACATTGATTGGCGCGACCGGCCCCACCATC
GGTCAGAACTACATCGTGGATGCCTTCCTTGTTGTTGCCGCCGGTGGCATCGGCCGGGTG
AAGGGCGCTGTGATCATGGCTTTCGTGCTGGGAATTACTCAAGCATTCGTGGAATATACG
ACAGGTGCGAGCATCGCGAAGTTCATCGTACTCATCGCTGTTGTTGCCTTCCTGCAGTTT
AGGCCTCAAGGACTCTTCCAAACCCAAACTAGGAGCCTCGTA >RXA01219-downstream
TGAGCACTCAACTCAAGCTGAAG >RXA01220-upstream
CAGGTGCGAGCATCGCGAAGTTCATCGTACTCATCGCTGTTGTTGCCTTCCTGCAGTTTA
GGCCTCAAGGACTCTTCCAAACCCAAACTAGGAGCCTCGT >RXA01220
ATGAGCACTCAACTCAAGCTGAAGAAGCCCGCAAAGAAGAAAACTACGCCGAAACTTAGC
GTCGTAAATGCTCCCACGCTGCGCACTGCGGCGTTGGGCCTGGCCGCGCTCGCTGCGGTA
TTGCTGTGCGCCCCGCTCTTTTTATCCACATTCCAGCTGACGTTGATGTCGCGCTTGGTG
TGTTATGCGATCGTCGCAGTCGGCATCGGGCTGGCGTGGGGCAGAGGCGGCATGCTCACG
CTGGGGCAAGGCGTGTTCTTTGGAATCGGCGCGTACATCATGGCCATGCACATGCTGTAC
AGCGATTCGCAGATTTTTGGGACCACAGTTCCGCAATGGTGGTCATTTTTGCCAACCCG
GCAGTCGCACTCATCGCAGTTGTGGCGCTTCCCGGCATCGTGGCTTTTGTGCTCGGCTTC
TCCATTTTCAAACGACGCATCAAAGGCGCCTACTTTGCCATCGTGAACCAAGCGCTCGCC
GCAGCTGTTGTGGTGTTGCTGGTCGGACAACAAGATTCCCTTGGAGGTTCCAATGGTCTT
TCCGGATTTCGATCGTTCATGGGTTTTGCCGTCTACGACCCCATCAACCGCATCATGTTT
TACTTCACCGCAGTGGGAGTTCTCTTGGCTTTGGTGGCTATCTCATATTGGCTCATGCGC
AGCCGCTATGGAGAACTGCTCGTGGCCACCAGAGATGCAGAAGAACGCGTCCGATTCCTC
GGATATGATCCCGCATTGATCAAAACCGCCGCATATGTCATTGCTGCGATGATTGCCGGA
ATCGCCGGAGCGCTGTTCGTGCCGATCGTGGGCATCATTTCACCCGCAGAAATCGGCGTG
GTGCCATCAATCGTGTTCGTGATCGCCGTCGCCGCTGGTGGCAGGGCATCCCTATTCGGT
CCCGTAGTTGGCGCGCTGGTGCTGGGCTGGTGGAATCCACACTTGCTCAAACTTTCCCC
AGCATGTGGTCCTATTTCCAGGGTGCGATCCTGGTTCTCGTGATCGTGTTGCTGCCGGGC
GGAATTGCTTCAATTAAACTTTCCGCGCTCAAAAATAAGGCCAGGAAGGCCACCTCA >RXA01220-downstream
TGAGCCTTAAAATCACCAACCTC >RXA01221-upstream
TCCAGGGTGCGATCCTGGTTCTCGTGATCGTGTTGCTGCCGGGCGGAATTGCTTCAATTA
AACTTTCCGCGCTCAAAAATAAGGCCAGGAAGGCCACCTC >RXA01221
ATGAGCCTTAAAATCACCAACCTCAAAGTCGCTTTCGGGTCGTTCATCGCCGTGAATGAG
ATTAGTTTTCAGGTGCTGCCCGGTCACGTCCACTTCCTCATCGGTGCCAACGGTGCAGGT
AAAACCACCTGCATTGACGCGATCAGCGGATTGGCGCCGGGGCAGGGATCAGTGCAGTTG Appendix A, page 31

Attorney Docket No.: BGI-125CP

```
GATGGCACTGAGATTCTGGGAACCCCTGTGCACCGCATTGCTCGGATGGGTGTGGGCGA
ACGTTTCAGACCGCCAGCGTGTTTGAAGAATTGTCTGTGTTGCAGAATCTGGATATTGCG
TGCGGGATTCATCGTCCGTTGCGGGCGCTTCTCGGGGTGCGTCATCGGATTGATCCCCGA
ATTGAACACGCCCTGGAGGTCACGGGTCTTGCTGATCTGGTGAATGCTCAGGCGGGAACC
TTGTCGCATGGGCAGAAACAGTGGCTGGAAATTGCAATGTTGCTGGTGCAGGATGCGCAG
GTGCTCATGCTGGATGAGCCGGTGGCGGGCATGAGTGAGGAGGAGCGTGTCGCAACGGGT
GAGCTTTTGCAGAGGGTTGCGCGGGGACGGGTGGTGTTGGTGGTGGAGCACGATATGGAG
TTCATGCGTCGTTTTGCCACTCGCGTCACTGTGATGAATCGCGGCACGATCTTGTGTGAG
GGGTCGGTCGATGAGATTCAGGCGAATCCGGATGTGCAGTCCATTTATTTAGGTACGGCA
GGGAAG

>RXA01221-downstream
TGAGTTAGTCATGTTGGAAATCA

>RXA01222-upstream
AATCGCGGCACGATCTTGTGTGAGGGGTCGGTCGATGAGATTCAGGCGAATCCGGATGTG
CAGTCCATTTATTTAGGTACGGCAGGGAAGTGAGTTAGTC >RXA01222
ATGTTGGAAATCACTAATTTGTGTGCAGGTTATGGCCGCACGCAGGTACTTCATTCTCTT
TCAATCTCCACGAGCAGCAACGGCATCCTGTCGATCCTCGGCCACAATGGCGCTGGTAAA
TCCACCTTGCTGCGAACCGCGGTGGGGTTGATTAAGCCGACTTCCGGAGAGGTCAAACTT
TTCGGCCAGGATGTCCACCTCGTTGTCCACGCATGAGCGAGTAAAGCGCGGAATGGCTTAT
GTGCCGCAGGGCCAGCAGTCTTTTACGCAGCTTAGTTGCATGGAAAATTTGCAGGTGGTA
GCGGATCTGCAGGGACGTGTGGGCAAGGCACGCATCGCGGAGGCGCTTGATCGCTTTCCG
GCGCTGACCCAGGTGCTGGACCGCCAAGCCGGCCTGTTGTCGGGTGGTCAGCGTCAGCAG
CTTGCCATCGCCCGCGCGCTGATCACGGCGCCAAAGCTTTTGCTTCTCGACGAACCCACC
GAGGGTATTCAGCCTTCGGTGGTTGCTGAAATTCAGCAGACCATCATCGATTTGGCTAAG
GACGGCATGAGCATTGTCCTGGTGGAGCAAAACATTGGTTTTGCATTGGATGCTGCAACA
AGCTACGCCATTGTGGCGCGTGGTCAGGTCGTGGAATCGGGACAAGGCGCTGAAACCACC
GCAGAGAAGCAGACTAAAGTGCGGGAATCTCTAGCAATC >RXA01222-downstream
TAGCGGCTGTGGATAGCGTTTTG >RXA01235-upstream
TTCTGAAGCTGTGCCGGCCGCTGCTTAAGTTTTCGTGCTGAAGAGAATTTTCCTCAACCC
CTGGGTGGCTACCGCGTTGTCGGTAGTCATTTTGGGGTTT >RXA01235
GTGGTGCTGTTTTCAGGTTTTAGCGGTGTTATTGATTTAAGCCCCACAGCAGTGATTAGA
CATTTGAGTGGGCAGGACACGCTCACCCCTCGAGATCAGGCCATCTTCTTTGATATCCGG
CTGCCTCGAATTATCGCTGGTGTCATTGTCGGAGCAACGCTGGCTATTTCTGGTGCTGCT
TACCAAGCGGTATTTAGAAACCCGCTGGCTGATCCTTATTTGTTGGGTGTGTCCGCAGGT
TCTGGCCTTGGTGTCACGGCAGTGATTGTTGGCGGTACCGTGCTGGGATTTTCTGCACCG
AGCATCGGCGTGATTGGTGCAGCATTTGTAGGTGGTGTTGCCGCAGTACTTGCCACGCTG
ATGGTGAGTCGGGGAGTAGGACAGGGATCATCAACCACCGTGGTTATTTTGGCGGGCGTG
GCGGTTGCTGCTTTTGCCAGTTCCATCCAGACCTATATTCAGCAACGACACATCGATACG
GTGGCGCGCGTATATGTGTGGATGTTGGGCAACCTCAATGTCACCAACTGGATGTCGATC
TTCATCGTGGCTGTGGTGGCGGGACTATGCGCGGCCGTGATCATGTCCTGCGCCAGGTTG
TTAGACGTGATGGCTGTTGGTGATGTGGAAGCCCGCACATTGGGCGTCGATCCAGGCCTC
GTACGCATTGGCATTGTCATCGTGGCAACCCTTGGTACAGCTGCAGTGGTATCCATTTCC
GGTCTCATCGGGTTTGTGGGCATCATTGTTCCGCACGCCCTGCGCCTAATTGTTGGCCCG
GGGCATCGGATTTTACTGCCACTGTCTTTCGTATGGGGTGCCATTTTCCTCGTGTTGGCA
GATACCGCAGGGCGAACATTGATGGCTCCTCAGGAACTTCCCGTGGGTGTGGTGACAGCT
GCACTCGGCGCACCGTTCTTCTTATTTATTTTGCGCAGAACCAGCAGACAACGAGTTCCA
AAAAGGAGTGCT >RXA01235-downstream
TAAGTGGCGATCATTGAATGCGA
```

Appendix A, page 32

Attorney Docket No.: BGI-125CP

>RXA01260-upstream
CTAAACGTGGGCTGCATTCCTTCCAAAGTCTCTGATCAAAAACGCTGAAGTTGCCCATAC
CTTTACCCATGAGAAGAAGACCTTCGGCATCAATGGCGAA >RXA01260
GTGACCTTCAACTATGAGGATGCTCACAAGCGTTCCCGTGGCGTTTCCGACAAGATCGTT
GGAGGCGTTCATTACTTGATGAAGAAGAACAAGATCATCGAAATTCATGGTCTTGGAAAC
TTCAAGGATGCTAAGACTCTTGAGGTCACCGACGGTAAGGATGCTGGCAAGACCATCACC
TTTGATGACTGCATCATCGCAACCGGTTCGGTAGTCAACACCCTCCGTGGCGTTGACTTC
TCAGAGAACGTTGTGTCTTTTGAAGAGCAGATTCTTAACCCTGTTGCGCCAAAGAAGATG
GTCATTGTTGGTGCAGGCGCAATTGGAATGGAATTCGCCTACGTTCTTGGTAACTACGGT
GTAGATGTAACCGTCATCGAGTTCATGGATCGTGTGCTTCCAAATGAAGATGCTGAAGTC
TCCAAGGTTATTGCAAAGGCCTACAAGAAGATGGGCGTTAAGCTTCTTCCTGGCCATGCA
ACCACTGCTGTTCGGGACAACGGTGACTTTGTCGAGGTTGATTACCAGAAGAAGGGCTCT
GACAAGACAGAGACTCTTACTGTTGATCGAGTCATGGTTTCCGTTGGTTTCCGTCCACGC
GTTGAGGGATTTGGTCTTGAAAACACTGGCGTTAAGCTCACCGAGCGTGGCGCAATCGAG
ATCGATGATTACATGCGTACCAACGTCGATGGCATTTACGCCATCGGTGACGTGACCGCC
AAGCTTCAGCTTGCTCACGTCGCAGAAGCACAGGGCATTGTTGCCGCAGAGACTATTGCT
GGTGCAGAAACTCAGACTCTTGGTGATTACATGATGATGCCACGTGCAACCTTCTGCAAC
CCACAGGTTTCTTCCTTTGGTTACACCGAAGAGCAGGCCAAGGAGAAGTGGCCAGATCGT
GAGATCAAGGTTGCTTCCTTCCCATTCTCTGCAAACGGTAAAGCAGTTGGCCTGGCAGAA
ACTGATGGTTTCGCAAAGATCGTTGCTGATGCAGAATTCGGTGAGCTGCTCGGTGCACAC
CTGGTTGGAGCAAATGCATCAGAGCTCATCAATGAATTGGTGCTTGCTCAGAACTGGGAT
CTCACCACTGAAGAGATCTCTCGTAGCGTCCATATTCACCCAACGCTATCTGAGGCAGTT
AAGGAAGCTGCACACGGTATCTCTGGACACATGATCAACTTC >RXA01260-downstream
TAGAATCCACCTCGTTGGCCCTG >RXA01261-upstream
GTGGGTGTTTTTCATTTTCTTCCACTCTAAAATTAAGTATGGAAAACCAACCGCACCCGG
ATGCACGACAATGACCCACTAAACACGTATCCTTGAATGC >RXA01261
GTGACTGAACATTATGACGTAGTAGTACTCGGAGCCGGCCCCGGTGGCTATGTCTCCGCC
ATCCGTGCAGCGCAGCTTGGCAAGAAGGTTGCTGTAATTGAGAAGCAGTACTGGGGTGGT
GTTTGCCTAAACGTGGGCTGCATTCCTTCCAAAGTCTCTGATCAAAAACGC >RXA01261-downstream
TGAAGTTGCCCATACCTTTACCC >RXA01269-upstream
GATTATCTCTGCGCCGATTCAGCTGGCAATAGCAGCAGTTGTATTGAGAGCTCATGGTCG
TCCGATTCTATTTCGTCAACCACGACCTGGGAAAGACGGT >RXA01269
GTGGTATTTGAGATGATTAAGTTTCGAACCATGCTTGAACCAGATGAAAAACATGTAACT
GATGAACAGCGTCTAACTAAAGTTGGAAAGCTTCTGCGGGAAACGAGTTTAGATGAGTTA
CCTACACTCTGGAATGTATTTAAAGGTGATATGAGCCTTGTAGGGCCTCGACCTTTGCTT
GTTAGCTATCTGGAACATTACTCTTCTGAACAAGCTCGACGCCATGAAGTTCGTCCTGGG
ATTACTGGTTTGGCTCAGGTGAATGGCCGTAATCAAACTACTTGGGATGAACGACTTAAG
TTGGATGTCGAATATGTGGATCGCTGTAGTTTGAAACTAGATTTCAAAATATTAATCGCC
ACTGTAAAAACAGTTCTTTCTAAAAAGGGCATTAGTAATGAAGGTCATGTCACGATGCCA
TCCTTCATTGAAGAAAGAAAA >RXA01269-downstream
TAGCAGGTAAAAATTTTACTTTC >RXA01291-upstream
AACCCGCAGCGGGTGGAGCGGGGCTGAGGGAGACGTCGAGAAGCGTCCCTTTCGGTTGTC Appendix A, page 33

Attorney Docket No.: BGI-125CP

TGGATTTCTCGCGGTAAAGTTTCCTGTGAAGGAGGCGAGT

>RXA01291
GTGGCTGATCAGCAAGATTTTTTGGGCCGTTTTGATGCGATGAGCTCAAAGGCGACGGCC
ACGGTAATCGCCCATTATTCCTCCAGTTTTACTCTGGCATCGAAGCTGTTGTCGCCGAAA
ATTCGTCGCGATATTGAGGCATTGTACGCAATGGTGCGAGTGGCCGATGAGGTTGTGGAC
GGCGCTGCTGCTGCCGCGGGGTGTGCGCCGGACGCCGTTGCGGAGATTTTGGACAATTAC
GAACGCCAGGTTCTGCTCAGTTTGTCCGTTCCTTTTCATACCGATCCAGTGATCCATGCG
TTTGGCAATACCGCCCGCAAATGTGGTTTTGAGCAGGCTCACATCGTGGCGTTTTTTGAT
TCCATGCGCCGCGATCTCTCCCAAACCTCCTATGATCCGACTCAGTTGGATGAGTACATT
TACGGCTCCGCTGAGGTCATCGGGTTGATGTGTTTGAAAATTTTCCTCCAAGATTCCACT
GCCAGCCCGCAGGATCGGGCCACGATGGAACACGGCGCCAGGCGTTTGGGTGCGGCATTT
CAAAAGGTAAATTTCCTGCGAGATCTAGCTGAAGACCGCGAAGGCCTAGGCCGTTCTTAT
TTGCCGGTATTCACCGAAGAAATGCGCGATGAGATCGTTACTGATATCCGAGAGGATTTG
GATGCCGCCCGGCTGAGCATTCCGCTGCTGCCATTTGGCGCGCGAACCGGTGTGCGCGCC
GCGACCGATCTCTACGGTTGCCTCGTGGACAACCTGGAATCCGCGTCCTCGAAGACTTA
AAAAACGGGCGGGATTTTGTGCCGTCTTTAAAAAAGCCAGCCTGGCAACCAAAGCAATGT
GGAAAGAAGTGTTTCAAAAATGACAAAAGCAGTGGTCATCGGCGGGGGACTAGCAGGACT
AGCCACCACCGCACTGCTCTTACGCGAAGGATA

>RXA01291-downstream
TGAAGTCCACCTCGTCGAACAAA

>RXA01292-upstream
TCCGCGTCCCTCGAAGACTTAAAAAACGGGCGGGATTTTGTGCCGTCTTTAAAAAAGCCA
GCCTGGCAACCAAAGCAATGTGGAAAGAAGTGTTTCAAAA >RXA01292
ATGACAAAAGCAGTGGTCATCGGCGGGGGACTAGCAGGACTAGCCACCACCGCACTGCTC
TTACGCGAAGGATATGAAGTCCACCTCGTCGAACAAAACGAGCACCTCGGCGGCCGCGCC
GGGACCTTCGAACTCGACGGCTTCCGCTGGGACACCGGCCCCAGCTGGTACCTCATGCCC
GACGCCATGTCCCACTTCTTTAAGCTCTGCGGCACCTCCATCGACGACCACCTCGACCTC
GTGCCACTTGAACCCGCCTACCGCGTCATCGACGACCACGGCGAATTCATCGACGTCACC
TCCGACATCGATGCGATGGCCGAGCTTTTCGAATCCCGCGAACCCGGCGCCGGCGCCAAA
CTGCGCACCTATATCGACTCCGCCACACAGGTCTACAACCTGGCCATCGACGGCTTCCTC
TACACCAACTTCACCAACTTCATCCCATACTTAAGCCCCGGCATGCTGCGCCTTTTACCC
AAACTTCTAGCAAGCCTGTCGACCTCGCTAAAAGTCAAGGTCAACACCCAATTCCGCGAT
ACAAAACTGCGCCAAATCTTAAGCTACCCCGCAGTTTTCCTCTCCTCAGACCCTTCGCAC
ACCCCGGCGCTCTATCACCTCATGAGCCACACCGACCTCGTCCAAGGCGTCTCCTATCCC
CGAGGCGGCTTCACCGCCTTCATCAAGGCACTAATTTCGCTTATCGACGACGCCGTCCTC
CACCTCGGCACCCCCGTCAGCGCAATCACCACCCAAGGCCGAAACGCCACAGGCGTCCAA
GTCGGCTCAGAGTTCATCGAAGCCGATATCGTGATCAGCTGCGCTGATCAGCACCACACC
GAAACCCAACTCCTACCTGCTTCGTTGTGCGCGAAGCCGGAGACGAGCTGGAAGAACAAA
CAACCCGGCCTCAGTACTGTGCTGGTTTTGGCAGGCGTGAAGGGGGAGCACACCCTGCTT
TTTCCTCCGACTGGGACGAAGATTTCCGCAAAGTTTTCGACGGCTCCACCCCAGAATTCC
CGGCTTCAGAATCCATCTAGATCTCCAAGACCTCCGCAACAGATTCCGATGCCGCACCCG
AAGGCCACGAGAACCTCTTCATCCTGGTCCCAGTACCCGCCGATGTCTCCATTGGTCACG
GGTCCGCTTACGGAGAAGAATCTGACATGGTGGGCCGGATCGCAA >RXA01292-downstream
TAGCAGCAGTGGCTCAAATTGGG >RXA01293-upstream
CGATGCCGCACCCGAAGGCCACGAGAACCTCTTCATCCTGGTCCCAGTACCCGCCGATGT
CTCCATTGGTCACGGGTCCGCTTACGGAGAAGAATCTGAC >RXA01293
ATGGTGGGCCGGATCGCAATAGCAGCAGTGGCTCAAATTGGGCGATGGGCTGGCATTGAT
GGTTTGGAAAGCCGCATTGTTGTGCAGCGCACCATCGGCCCTGCCGACTTCGCAGACCGA
TACAACTCCTGGAGCGGCGGGTCCATTGGCCCTCACACACCCTGGCACAATCGGCGTTC
TTTAGGGGTTCTAACAAATCCCGCAAAGTAGATGGCCTGTATGACGCAGGTGACACCACA Appendix A, page 34

Attorney Docket No.: BGI-125CP

```
GTTCCAGGGGTGGGCGTATCTATGTGTTTGATCTCTGCAGAAAACGTGCTCAAGCGTCTC
CGCGGGGACAACAGTGTGGATCGGACT

>RXA01293-downstream
TAACGGGACTTTTTTCTTTTGCT

>RXA01339-upstream
GAGAAGGCGGAACCGAAGGAATCGAAGAATATCTCTCCGTGCGTTACCTCGCTTTGCCGT
GACACATGAGCTGTCCGGTGAATAACCCGAAGGAAAAAAC >RXA01339
ATGACTACCGAATCAATAGTTGCGCACAATGCTGCAGGTACAGCACCTCAGAATGTGTCC
TCTGCTAAGAAGAAGTACCTCAGCGTTGCCCAAGGCGTTGCCCTTATCTACGGAACCAAC
ATCGGCGCCGGTGTGCTCAGCCTCCCATACGCTGCCCGCAACGGTGGTTTCCTCGCCCTG
GTTGTTGCCCTGCTCATTGCGGGAACACTGACCACCATCTCCATGCTCTACATCGCCGAA
GTATCCCTGCGCACCAAGAAGCCACTGCAGCTTTCCGGCCTGGCAGAAAAATACCTGGGG
CAGTGGGGCCGCTGGCTGGTGTTCATTGCCATTGTGGTCAACAGCGTGGGTGCACTGATT
GCCTACGCATCAGGATCCGGCATTTTGATAGGCAACCTCACCGGCCTGCCACCAATCGTG
GGCACCCTTGGATTCTTTGTTTTAGGCACCTTGATCATGTGGAAAGGCCTGCACACGGCA
AGCTTCGTGGAGGCATTGATCACCACTGGCATGGCAACGATCATCATCGTGCTGTGTGGA
TGGACAGTGCTTGGCCCTGGAATTTCCGCAGACAACCTGATCGTGTTCCACCCATTCTTC
ATCGTTCCGATCATGAACCTCGCGGTCTTTACCTTCCTTGCCCAATATGTGGTTCCAGAA
ATCGCACGAGGAGTTAACCCTGCCACCCCGAAGGCAGTGCCACGCGCGATCATCATCGGC
ATGGTCGCAACTGGTGTCACCCTGGCAGCTGTACCATTCGCGGCACTAGGGCTTCTGGGC
ACAGGCGTCAGTGAAGTTGTCACCATCTCCTGGGGCGAAGCACTCGCCCCAGTGGCCTAT
TACATGGCCAATGCCTTCGCACTATTGGCCATGTTCACTTCATTCATCGCCATTGGATTC
ACCGCGATGCGCAACGTACTAGATATGGCCACTGGCCACAACACGGATGGCAGCGATCC
GTTGCTGTCGGACTAACTGTTCTTCCACCACTGGCAATTTCACTTGCGGGATTAGGCGGA
TTCGTGGCAGCACTGAGCTACGCCGGAGGATTTGCCGGAGCAATCATGTCCATCATCCCC
GTGCTGTTGCTGCGCAACTCCCGCAAGAGTGGCGACCAAGAACCAGTGTGGAAAGCCACC
TGGCAAGCGCACCCCATCTTCCAGATCCTGTTGATTGTGGTGTACTCCCTGGCGTTTGTG
TACTCGGTTCTCGCGATCGTCGGATTAATGCCTGCGGGTTGGGCA >RXA01339-downstream
TAGTCACTTCCTGTTGTGGCTGC >RXA01382
TCCACCTCCACCGCAGCTGGCACCGGAACTGCAAATGAAGAAGGCACCATCACCGCAGCC
ATCTCCTACGAACTGGGAACCAACGGCTACGACCCAATGACCACCACCTCGGCTCTCACT
GTGGCAGCCAACTGGCACACCCTTGAAGGCCTCACCGAAATCGACCCAGCCACCGGCGAG
GTCTACGCAGCACTCGCCAGCGCACTGCCTTCAGCCGATGCGACCTCCCTAGACATCAAG
CTTCGCGACGGCGCCACCTTCCACAACGGCGACGCAGTCACCGCAGACGACGTAGTCTTC
TCTTTTGAGCGAGTCCTCGATCCAGCCAACAACTCCCTTTACGCATCCTTCATCCCATTC
ATCAAGTCAGTCACCAAGAAGGATGACACCACCGTCACCATCGACCTCGACTACGCAACC
GGCATCATCAGCGAACGCCTCGCAGTAGTAAAGATCGTGCCAAAGTCCGTCGTGGAAGCA
GACGCATCCGGATTCGACGCCAACCCAATCGGCTCCGGCCCATACAAGATGACCGACAAC
GGTGCATCCAAGGTGGTCAAGTTCGAGCGCAACGACGACTACAACGGCCCACGCCCAGCA
CGTGCCGCCAAGATGGAATGGCAGATCATCCCCGGACGCCTCCACCCGCACCAACTCCCTT
CAGTCCGGCAGCACCATGGCCATCGACTCCGTTCCATACCTGTCGATCCCACAGCTTGAA
GCCACCAGCACCGTAGAATCCGTCCAAGGATTCGGCCTCCTGTTCGCCATGTTCAGCTGC
TCCGAAGGCAACCCCTTCAACGACGTCCGCAACCGCCAGGCATTCCTCTACGCACTGGAC
ATGGACAAGATCGTTAAGACCGGCATGTCCGACCAGGCAACCCCAGCCACCTCCTTCGTG
CAGAAGGAACACCCCAACTACAACCAGGCATCCACGGTCTACTCCCTCGACGCCGACAAA
GCCAAGGCGCTGTTCGCTGAAACCGGCCTTACCAGCCTCAACCTCCTGTGCACCGACCAC
GACTGGGTCAAGAACTGCACCCCACTGATCCAGGAATCCCTC >RXA01399
ATTCTCAGCCCCGCAACCGCACTTGTCCTGGCGATTGGATTGATTGCTGCTGCAATTATC
CCTCCCCTGCTTGCTGCTCGCGGAGTTAAAACAGCCGAAGCCCGGCGCGCTGAATCCAGC
GAAGCCTACTTGAGTTCCTTGGATCAGGTGCTGTCCAACCAGGCGGCGCTTCGTGTTCGT
GGTGAAATGCCGGCCGCTCTGTCCAAGGCGGATGTGGCTGCGCGTTCCTATTCTTCTTCA
```

Appendix A, page 35

Attorney Docket No.: BGI-125CP

```
CTGGAGGCAGGCGCGAAAGACACTGCCATTGGCGCAGCGAGTTCCCTGTGGATTCACGGT
TTCACTGTCATTGGTGTGCTCATGGTTTCCGCGTCACTGTATGCAGATGGAAGCCATTCA
CCGCAGTGGTTTGGTGTGTTGGTGCTGCTTTCACTCGCAGCTTTCGAGGCTGTCTCTGTT
CTCCCCGATGCTGCGATTGCTCGTACCCGCGCCGCAGATGCCACCAGGAGGCTTGCGGAA
ATCTCGGCGCTGCCAGAATCTGTCTCTCTTGAGCTTCGCACGGCCTCTGACCAGCCCGTA
TTACGCGCCGAGAATCTAGTTTATGGATGGGACAGCGACCTAGGCACGAGCAACCTGGAT
CTCACCTTTGGTTCACGACATGAAATCATCGCACCCTCTGGAACTGGCAAAACGACCCTG
CTGCTCACACTTGCGGGGCTGTTGGAACCTCGTGGAGGCCAAGTGCTTATCGACGGCACC
AATCCTTCCGAGTTGAAAAACGCCGTGCTGTTCAGTCCAGAAGATGCCCACATTTTTGCC
ACCACTGTCCGAGATAACTTAGCACTCGGAGCACCGGAAGCAACCGACGCGGAAATGACA
TCGATCCTGGAACATGTTGGTTTGTCAGAGTGGGTTCAAGGTTTACCCGATGGTCTTGGC
ACTGTCCTTGATTCAGGTGCCGATAGTCTCTCGGGAGGTCAGCGCCGCCGCCTGCTCCTT
GCCCGCGTACTACTAAGTGATGCACCAATTCTGCTTTTGGATGAACCCACCGAGCACCTC
GACACTGCAGGCTCCTCTGAAATCTTGTCTATGCTGGCCTCCGATGAACTCCCTGGTAAA
AGAGCTAGGAGAACCGTAGTGATTGTGAGGCATGTGAGG

>RXA01399-downstream
TAATTTTGCCCCGCTGTCTTCTG

>RXA01419-upstream
GCGCCCACTCATCGGCGAGCTTCAGGAGATGAGGTTGATGCTCCATTGATAATTTCTTTC
GCTAATAGTCAAATGATCATTTGAGTGTTAGTGTTTTCTC >RXA01419
ATGCTTCTTTCCGCCCGCACACACACGAGTTTCCAAGAACTTGGACTCAATGCTAGTCGG
CGCAAAGCAATCAACTGGACACTGGCACTCACTGTGGTGCTAATTGCCTCCATGTTTGTT
GGCGTGCTCATCGGTGCATCCGGGACCTCAGTGTTTTCCACGTGGACCGTAATTAGCCAC
CATCTTTTTGGCACTGAGCTAGGTGGCTCCGACACTGCCGACGCCATCATTTGGTACATC
CGCACCCCACGCGTCTTGCTCGCT >RXA01420-upstream
CGAAGTTCACGACTACAGGCATTACCTGGGTGCTGATTTTGCGCGAGTAAAGCTGTGGCT
GCGGAATGCGCTGCTCATCCACACGTGGAATCCTGATTGG >RXA01420
GTGACGCTGGGTGGATTGAATGTACCATCGTGGTCGCTGGGCGCGGAAATGCTGTTCTAC
CTGACGTTCCCGCTGTTTATTCCGTTAGTGCGCAAAGTGAAGGGCGTGGGCAACTGGTGG
GCATTTGGCATCACCTTTGCCGTGAGCCTGGCGCTGATTACAGTGATTCACTTTTATGCG
GACGGACCAAAGGGGATTGAGAACTTCTTTGTTCCTCGCCTGTGGGACACCAATGTGTCA
CCGGTCGCGGAAGTTCACGCCGATCCAGTGTGGTTTATGCAGGAAGAAATTCCCGTGCTG
GAATCTTACTGGCTGTCTTACTACTTCCCGCTGACCAGACTCATCGAGTTCTACCTCGGT
GTGTTTGGCGCGAAGCTGGTTGCTGAAGGCATGTTTAAAAACACCAACATCACCATCCCG
CTGATCGCACTGGCTGTTTCTTTTGTTGCTACTTGGTTTGTGCCACTGGCATTCAAGATG
TCTGTCATCATGTCCCTGCCAATGGCTTTTGTTGTGGCAACGCTTGCGGTGAGAGACATT
GAAGGCAAGAGTGGGGAAATCGCCTCGCCTCGCGCAGTTTTGTTGGGTAATATTTCCTTT
GCCTTCTACATGGTGCAATTCCCCGTCATGGTGTTTGTGCAGCGCTATTTCATTGCTGGC
AAAGAATACGGCTTCCTTGGCTGGGCATTCTATGCAGTGGTGTGTTTCATCGTGTCGGTC
ATTCTCGCGTGGGTGCTGTTACCTTCGTTGATGATCCTT >RXA01420-downstream
TAATAAGGCCACGGAA >RXA01467-upstream
GCGTCATCTTTAGCCTTGCTTTATGAGCTTTTCCCCGCAATGAGCCGCGTTGTGTATCCA
TAAGTCTTAGCCTACAAGCGCTTTGAGGTAGTTTGGGATC >RXA01467
ATGGATTTCAACGACAAAGCCGCTTCAGAAAACGCTGTAAAGACTGGCGCAGAAGGCCCC
AACGTTTTCGCGAGCGTGGCCAAGATTTTGCAGGATGTTGGCGGAATTTCAGCCGAAGAC
GTCACTCCGGAATCTCGTTTTACTGAGGATTTGGCAGTGAGCTCACTCAATTACATCGAG
TTGATTGTCAATGCGGAGGACGCATTTGGTGTTCGCATTGAGGACGCCGATGCCAAGGAT
```

TTGACCACCGTGCAGGATTTGATTGACTTTATTAACACCAATAAGGCTGAT

>RXA01467-downstream
TAGCGGGAAAATTTCGCCCAAAA

>RXA01538-upstream
TCTAAACTCACTCTCAACTCACCAAGATTGTTCAACAATCTGCGATTGGTGTGCAATCTA
CCCCAATCATTTTGAAAGCCCCCACGAAAGGAGCGCGACA >RXA01538
ATGGCCGACAACAAAAATGCCGATGACAGCCAGCTAGTCTCAGCCAGCACTGGAACCCCT
GGGCCTGGCGACATTGCAAAAGCCAATGCGCCATCCCTCAAGCAAGCTGCAGTAACCGCC
TCTGGCCGAAGCGCTCTGATGGGTGCCATCTTCCTCATGGCAACTTCTGCCATCGGCCCA
GGGTTCCTCACCCAAACCGCTGTCTTCACCAACCAGCTCGGCGCAGCTTTCGCATTTGCG
ATCCTGGTGTCGATCCTCATTGACATCGCGGTGCAGCTGAATGTGTGGCGCATCATCGGC
GTCTCTGAAATGCGCGCCCAAGAACTCGGCAACACGGTTATCCCAGGTTTTGGTTGGGTG
CTGGCCGTACTGGTCTGTATTGGCGGCGTA >RXA01576-upstream
ATCGGTGATCTTTCGCGATTGATACGTGCGCGATTGCGTGCCCGCCAGCTGCTCAAGATC
AATGGATTTCATGACAATCAAGTTATCATCACTGGGGTCG >RXA01576
GTGGCACCTAACAGGAAAATCAGCCATCATGCACTAGGCTCTATTCCTATCATGGATGCA
TCAAAAAACAGCGACTTTAAAGACACCTGGCTAGTCGTACCTTGTTATAACGAGGCAACA
GTTATCCGGGAAGTTTTAGAGAACGCACTCAAAACATTCCCTAATATTGTTGCGGTCAAC
GATGGCTCCCCGGACAACTCCGCGGAAGAAATCCATGCGGCCGGCGCACACCTGGTCAAC
CACCCCGTGAACCTCGGACAAGGTGCCGCGATCCAAACCGGCATCGAATACGCCCGCAAG
CAACCCGGTGCAAAATACTTTGTAACTTTCGACGCCGACGGCCAACACCAAGTGAAAGAC
GTTATCCGCATGGTGGAGCGACTGCGTGCCGACGACGTGGACATTATCGTCGGCACGCGT
TTTGGACGCCCACGCCAAGCCGATGACCAGGTGCCACTAATCAAGCGCCTTGTGCTGCGC
ACCGTGGTCCTGCTGTCACCGAAAACCCGCCGACTTGGGCTCACCGACGCCCACAACGGC
CTGCGCGTATTCAACCAAAAAGTGGCGCAGGAAATGAACATCCGCATGAACGGCATGTCG
CATGCATCCGAAATCGTCGACCAAATCGATGAACGCGGCTGGCGCATTTCAGAAGAACCC
GTAGACATCCTCTACACCGAATACTCCATGAGCAAGGGGCAATCCCTGCTCAACGGCGTA
AACATCCTGGCCGACGGCTTCCTAGCGAGGAGACTCCCA >RXA01576-downstream
TGACGCAGACCACCACCCAAATC >RXA01580-upstream
CGGTAAACGCCTCATTAAAGTCCAATGCCATGCTCATAACACTAACAGTTAACCGTGCGG
TCAACTTTGCTCCCTATCCTTAAAAAGCCCACAGAAAAGG >RXA01580
ATGTATAAGAATATGCACATTGTTGCCCATCGCGGTGCGGAAGATCTGCACCTCGAAAAC
ACCATGACCGCTTTCCAGGCTGCCGCGCCCGCTGACGCTTTTGAGCTGGATATCCACGCC
ACCGCTGACAATCAGGTCGTCGTTATCCACGACCGCACCGCAGCGCGTGTTGCCGCGCCA
GATTCCCTGCACCGCGACACCCCGGTTGCGCGCTTAAGCGCCGCGCAAATCAAGGAGATA
ACGCTTATCGACGGATCCCCCGTACCAACCCTGGAGGAAGTTCTACTCCAGACGAGCCTG
CCGATCCAAGTGGAAATCAAATCTGCCGGTGCAGTTCCAGCAGCCGCAGCATTATTGCAG
AAATACCCAGAGCACCTGGAGCGCCTGCTGTTCATCAGTTTCATCGATGCAGCACTGGTG
GAAATCGTGGATCGACTGCCAGAAGCTCGCGTGGGAATCTTGCGCGATGCGTCCATGGAT
GATCTGCGCATTCTTGATTACATCCCGCTAAAAAATGTGGGCGCGATCTTGCCCTCGTGG
AAAGCACTAAACGTGGCGTCAATTGCTGATCTACATACCAAGGGAATCAAGGTTGGCTGC
TGGACAATTCGGGATGAAAATGCGTTTGGGATCGCACAACAAGCTGGCGTTGATTACCCC
ACTGTTAGCGATCCCTCTCGTTTCTCGCGCCCTCCCCTGCTG >RXA01584-upstream
CCACCCCCTTCCCCGCTACGCGCCATACCGGCTTGGGCGGGCATCGGATCACTA Attorney Docket No.: BGI-125CP >RXA01584
GTGGTGTTTTTGGGCGCACTTCTCGGCGCCGTAATCATGGGCGGGTTTTATCCAGCATTC
ATTCAAGCCGGATCCACAGTGTTCGGCGGCGGCCACGTGGTTTTGCCACTGCTGGAAAAG
CTCGTTGTTGCGCCCGGTTTTATTAAAGAAACCGACTTCCTATCCGGCTACTCCGCAGCC
CAGGCAGTGCCTGGCCCCATGTTCAGCTTCGCCAGCTACCTCGGCGCAATCTACGGTGGC
ATCGGTGGTGCAGTGCTGGCCAGCCTGGCGATCTTCTTCCCCGCCGCACTCTTGAGCATC
AGCGGAATGTACTTTTGGGGACGCTGGCGAAAAGCACCCGCATCCAAGCAGCAGTCACC
GGCATCAACGCCGGTGTGGTGGGGCTTTTGGGCGCAGCGCTCTACGATCCCGTATTCACC
CACGGCATCACCAGCGTTTCCGCATTAGCTATCGCAACGGTGTGTTGGCTGGGGCTAGCC
CACTGGAAAATTCCGCCGTGGGCCATCGCCGCGGGTGCGGCCCTTGCAGGCTGGGTCTTG
CTT >RXA01584-downstream
TAGAAAACGCTCAGACCCAAACC >RXA01591
GCCTCACTTAACTGGTCAGTCATCGTTCCAGCCCTAGTCATTGTCCTAGCGACAGTGGTG
TGGGGTATCGGATTCAAAGATAGCTTTACCACCTTTGCTAGTTCTGCGTTGTCAGCAGTA
GTTGACAATCTCGGCTGGGCCTTCATTTTGTTTGGCACAGTCTTTGTATTTTTTATCGTT
GTTATCGCCGCTAGTAAATTCGGCACGATTCGCTTAGGCCGCATTGATGAAGCACCAGAG
TTTCGCACGGTGTCATGGATTTCCATGATGTTTGCTGCAGGTATGGGTATTGGTTTGATG
TTCTACGGAACCACAGAACCTTTAACCTTCTACCGCAATGGTGTACCTGGACATGATGAA
CACAATGTTGGCGTTGCTATGTCCACGACAATGTTCCACTGGACCTTGCATCCATGGGCT
ATCTACGCAATTGTGGGCCTAGCCATTGCCTATTCGACCTTCCGAGTGGGCCGTAAACAG
CTTCTAAGCTCTGCATTCGTGCCACTCATTGGTGAAAAAGGTGCAGAAGGATGGTTGGGC
AAGCTCATCGACATCCTGGCGATTATCGCCACCGTATTCGGCACGGCATGTTCCCTTGGC
CTTGGTGCCCTGCAGATTGGTGCAGGCCTGTCCGCAGCAAACATCATTGAAGATCCAAGC
GATTGGACCATCGTTGGCATTGTTTCTGTTTTGACCCTGGCATTTATCTTCTCCGCTATT
TCTGGTGTGGGCAAGGGAATCCAGTACCTCTCCAACGCCAACATGGTTCTGGCAGCTCTG
CTCGCGATTTTCGTGTTCGTTGTCGGACCAACCGTGTCGATTTTGAACCTGCTGCCAGGT
TCTATTGTGAACTACCTGTCCAACTTCTTTCAAATGGTAGGCCGCACTGCCATGAGTGCC
GACGGCACACCAGGTGAGTGGCTTGGTGGCTGCACCATCTTCTAC >RXA01604
GACACACCCTTCGCCGATGTTGAGATAGCTCCAGACAGCGGACTCACTTTGCTGAGCACC
GGGCGCGAATCCCAATCCAGTTCCTTTTCTTTGGTACTTTCCGGCCGCATGCGCGCCTCC
ACCGGAACCATCGAATTAAACGGCGAACCCATCAAGGCAACCAAGCTGGCCAAGCATGTG
GCTTTGGCGGGCATCCCTGAAATCGATTCACTCGAGCGACTTGTCACTGTGCGCACCGTT
GTCCGTGAACAACTCGCCTGGTCAAGCCCTTGGTACCTGATGGTGCCCAGGGATATTAGT
GATTCGGGACGGTGGGTTGACGTCGAAAAGCATCTTGGCCTGAACCTGAACCCTAAAACC
TTAATCGGCGACCTCAGCGTGCTCGAGCGTTTTAAGCTGCGCATCGCGCTGGCGCTGCTG
GCGCGGCCAGAGGCGCAACTGTTGGTCGTGGATGATCCCGATCAAGTGCGCAGCATGGAA
TTGCGTGCGGAGGTGTTGCACGCATTGAAAGGCGTTGCAGAGGATCTCCCTGTGGTCGTG
GTATCCACCAACCCAGATTTTGATTCCTTGGCCGATACCGCTTTGACCATTACGGGGGCT
GGAAAC >RXA01604-downstream
TAATGGCATTTTTACACTTTGGC >RXA01614-upstream
TGCAATTCGCAAACATGAGTAGTATCGCGGAAGTTTCACCACGTGAACATTTCAGTCGAC
TCGCGCACACCACACCAACAATCGACCTATCGTTATACGT >RXA01614
ATGAATCAGATGCAGCAGTGGAAACCAGACTTCCTGGGAGAGGGCTACCAAAACCTCACC
ATCGAGCTCGGCGACGACCCGGATAATGAAACAGATGTTGTGACAACGGTTGTGCGCTAC
AACCCAGACAATCACGCGGACGAGTCTTTTGCTGCCCGCCCAGCGTTGCTGTGGGTTCAC
GGCATGACGGACTACTTCTTCCACACTGAATTCGCGGAGTTTTTCCACAATGCCGGTTTT
GCTGTGTACGGCATTGATCTTAGAAAATGTGGACGCTCCTACCGTCCAGGACAGCAGTGG
CACTACACCTCTGATCTTGCCCATTACTTCCCTGACTTAACAGCTGCTGCCGAGGTCATC
TCTTCCACCCACCCTGAGCTAGTCCCCGTCGCCCATTCCACTGGTGGACTCATCGTTCCT Appendix A, page 38

Attorney Docket No.: BGI-125CP

```
CTGTGGATGTCCCAGATGCGCACAAGCAATCCAGCTGCCATTGAGAAGATTCCAGCGCTG
GTCCTCAACAGTCCGTGGCTGGACATGATGTATCCACCACTGTTCATCAAGCTGATCACC
CCTATGGTGAGGGTGTTGGGCAAACGCTCCCCCACAACCATCATCCCAGGCGGAGGTTTG
GGAGCATACGGAAAATCGATCCATAAGAACTTTTACGGCGAATGGGACTTTGACACCACC
ATCAAGCCTGTAGAAGGACATAAAAAGAGCATCGGATGGCTTCGGGCAGTCATGGCTGGC
CAAGCAGAAATCCATCACGACCACGTGAATGTCGGAGTGGACGTGCTCACGCTGTGTTCA
AATAAGTCCTGGTTGAAGTCTGAATACACAGAGGACACCAACACTTCAGACGCGGTTTTG
GATGTGAAACACATTCAAAAGTGGGCTCCTCATTTGAGCTCGCCATCGTCCAGGGTTGAT
GTTGAGATCATCGACAACGCTCGCCACGATATTTTCCTCTCAAGGAAACCCGCCAGAGAT
CACGCCTCTGAAGTACTCAACAACTGGCTGCAATCGAAGCTTTCCAGCCTCAAACCATCT
CAA

>RXA01614-downstream
TAACACCGCGAATTATAGACTGA

>RXA01629-upstream
CAGGAAGAAGTTAACACCGCCCAGGGGTGCGTTGGATGATGATCATCTACAAACAAACAT
TCCGTTATGCACTCATAAGATATGACGAGAGGTTTTACTC >RXA01629
GTGAGCCCGATTCGCTCAAAAAAGAAAATCAAGAACGAACCAAGACTAACAGTCGATGAC
GTCAACGTTGTTCCCCCAAAGAAGATCCGTCCGGCCATTAAAGGCACTGTGGTGGGTAAC
TTCATGGAGTGGTACGACTTCGGAATTTATGGTTATTTGACGGTCACGATGACCGCAGTA
TTTACCCAAGGCCTGCCGCAAGAATGGCAGTTGTTGGCCGTGATGTTTGGTTTCGCGGTG
TCTTATTTAGTTCGCCCGCTTGGTGGCCTGGTTCTGGGTCCGCTTGGCGATAAGGTTGGC
CGCCAGAAGGTTTTGTACGTAACCATGGCCATGATGGCCGTGCTACGGCGCGTGATTGGC
TTGCTGCCGACGGCGGCGTCGATAGGCGCTTGGGCTTTGGTGCTTTTGTACCTGTTGAAG
ATGGTGCAGGGATTTTCGACTGGTGGTGAATATGCTGGTGCGACCACCTATGTTGCTGAG
TTTGCGCCGGATCGTCGACGAGGTTTCTTCGGAGCTTTCCTAGATATGGGTTCCTACCTG
GGCTTTGCCGCGGGTGCTTCGGTCGTGGCGCATTACCTGGGTGACCACTCACTTCTAT
GGCGCAACTGCCATGGAGGATTTCGGTTGGCGTATTCCTTTCCTGACTGCGATCCCGCTG
GGCATCATTGCGGTGTACCTGCGTACTCGTATCCCTGAGACCCCTGCGTTTGAGAACAAC
CAAGACGAGCCAAATGCAGTTGTTGAAAAGGACACTGAAGATCCTTATGCACGCCTGGGC
CTGGCTGGTGTTATCCGCCACCACTGGCGTCCACTGCTGATTGGTATTGCGATTGTGGCA
GCGACCAACACCGCCGGTTACGCGCTAACCAGTTACATGCCTGTGTATCTAGAGGAGCAG
ATCGGTCTGCACTCCGCATCCGCTGCCGCTGTGACCGTGCCGATTCTGGTTGTTATGTCC
CTGCTGCTGCCATTTGTTGGTATGTGGAGTGACCGCGTGGGCCGCAAGCCTGTCTACGCG
ACTGCTGTTGCGGCAACGCTGATCTTGATGGTTCCTGCCTTCTTGATCATGAACACCGGA
ACCATCGGCGCCGTACTGATTGCACTGTCCATGGTTGCTATTCCAACCGGTTTGTATGTG
GCACTGTCCGCATCTGCCCTGCCAGCGCTGTTCCCAACCGCGTCACGATTCTCTGGAATG
GGTATTTCCTACAACATTTCCGTGTCGTTGTTCGGTGGTACAACCCCGCTGATCACCCAG
TTCCTGCTGCAGAAGACTGGCCTGGATATCGTTCCAGCGCTCTACATCATGTTCTTCTCT
GCAATCGCAGGTGTGGCGCTGCTGTTCATGACCGAGTCTTCACAGAAGCCACTGCTTGGC
TCATTCCCAACCGTGGAAACCAAGTCTGAGGCCGTGGAGATCGTGAAGAACCAGGACGAG
GATCCAAATATTGATCTTTCCCATATGCCGTTTCCTGATGAGGAAAACGTAGGTGCTGAA
AAGCAAAACGCA >RXA01629-downstream
TAACCGTAAAGCCCGCTGCAAGG >RXA01644-upstream
GTAGGTAGAGGCTTGTGGTCACTACTTGTGGCCACATTTTAAAAAAATGCACAAGAAGAG
AAAGCAAAGCATTATGAGTAACGCCGTAGCGCAGGACCTC >RXA01644
ATGACCATCGCCGACATCGTCGAGGCCACGACCACTGCACCCATCCCATTCCACATCACT
GCCTTCGATGGAAGCTTCACTGGCCCTGAAGATGCTCCCTACCAGCTGTTTGTTGCCAAC
ACGGATGCAGTATCCTACATCGCAACAGCGCCAGGAGATTTGGGTTTGGCACGTGCCTAC
CTCATGGGAGACCTCATCGTGGAAGGTGAGCATCCCGGCCATCCTTATGGGATCTTTGAT
GCGTTGAAGGAGTTCTACCGCTGCTTCAAACGCCCAGATGCATCCACCACCTTGCAGATC
ATGTGGACTCTGCGGAAAATGAATGCCTTAAAATTCCAGGAAATTCCACCAATGGAACAA
```

Appendix A, page 39

```
GCCCCTGCATGGCGTAAAGCACTGATCAACGGGCTAGCATCCAGGCACTCGAAATCCCGC
GACAAGAAAGCCATTAGCTACCACTACGACGTGGGCAATGAGTTCTACTCCCTGTTTTTA
GATGATTCCATGACCTATACCTGCGCGTATTATCCAACGCCAGAATCAAGTTTGGAAGAA
GCCCAAGAAAACAAATACCGCCTCATCTTTGAAAAACTGCGTCTGAAAGAAGGCGATCGC
CTCCTAGACGTGGGATGCGGTTGGGGAGGCATGGTCCGCTACGCCGCCAAACACGGTGTG
AAAGCCATCGGAGTTACGCTGTCTGAACAGCAATATGAGTGGGGTCAAGCAGAGATCAAA
CGCCAAGGTTTGGAAGACCTCGCGGAAATTCGCTTCATGGATTACCGCGATGTTCCAGAA
ACTGGATTCGATGCGATCTCAGCAATCGGCATCATTGAACACATCGGTGTGAACAACTAT
CCCGACTACTTTGAATTGCTCAGCAGCAAACTCAAAACAGGCGGACTGATGCTCAACCAC
AGCATCACCTACCCAGACAACCGCCCCCGCCACGCAGGTGCATTTATTGATCGCTACATT
TTCCCCGACGGTGAACTCACTGGCTCTGGCACCCTGATCAAGCACATGCAGGACAACGGT
TTCGAAGTGCTGCACGAAGAAAACCTCCGCTTTGATTACCAACGCACCCTGCACGCGTGG
TGCGAAAACCTCAAAGAAAATTGGGAGGAAGCAGTTGAACTCGCCGGTGAACCCACTGCA
CGACTCTTTGGCCTGTACATGGCAGGTTCGGAATGGGGATTTGCCCACAACATCGTCCAG
CTGCACCAAGTACTGGGTGTGAAACTCGATGAGCAGGGAAGTCGCGGAGAAGTTCCTGAA
AGAATGTGGTGGACTATC

>RXA01644-downstream
TAAAGAAACAATGTTTCTTTTTA

>RXA01667-upstream
TCTCGGCGTTGATGATCATCCGCAATATCATGCCGCCGCAAGATTCCGCTTTTCCAGACT
TTGCTCATTCCTTCCTCTATTACTGCTCGCCATCATCGGC >RXA01667
ATGATTTTGGGGCCTAAGGTGTTGGGTCTGATTGGTTGGTCGGATCATCTTTCCACTTAC
ACTACGGTGCTCATTGCGATTGTGTTTGCTTCGATGCCGTATTCGATGAAGTTTGACCGT
GGCGTGCGTACTGGCATGAAGACGATGTGGGCGTATTCGACTGCGATGTTTGTGGGGCAG
TGGGGTCTGTTCATTTTGCTGGGTCTGTTTTTGTTCCAACCGGTGTGGGGTACCGATGAG
TGGTTCGGCATGATGTTGCCGGTTGGTTTTGTTGGTGGTTTTGGTACTGCTGCTGCGGTG
GGTACTGCGTTGGAGTCTTCGGGTGCGGAGGCTGCGATGTCTTTGGGCTTTACCTCTGCG
ACGGTGGGTACTTTTGCTGCGATTGTTGGTGGAATTATTTTCACAACGTGGGGTATTAAG
AAGGGCAAGACTGCGGCGATGCCTGCGCAGTTGCCGTGGGATTTGCGTTCGGGTTATATC
GATAAGCTGAGTGATCGTCCGTCGATTGGTAAGGCGAGTACGAATCCGTCTGCGATTGAG
CCTTTGGCGCTGCATACTGGCATTATTTTGTTGACTGTTGCGGTTGCGTATTCCATTAAT
CAGTGGTTGGGTAGCATGTTCCCAACCGTGCAGATTCCGTTGTTTGCGATGTCATTTGTG
GTCGGCATTGTGGGCATGGGAATTATGCGTTTGTTGAAGAAGCCTGAGTATTGGATCGC
GACACCGTGAATTCCGTGTCGGGCGCGGCGACGGATTACCTCATTGCGTTTGGTATTGCC
TCGATTGCTCCTGCTGCGATTGCTGATTACTGGGTTCCTCTTGTGGTGCTGTTTGTTTTG
GGCACCATCAACTGTTGTTTCTTCTTTTTCTGGGTTGCGCCTCGTTTCTTTGGCGAGAAG
TGGCTGGAGCGCGCGATCTTCGGTTGGGGTTGGGCTACTGCCGCGGTTGCTACCGGTATC
GCGTTGCTGAAGATCGTGGATCCGAAGTTGAAGTCGGGAGCGCTTAATGAGTACGGCGTG
GCTTATATCGGTTTTGCTCCATTTGAAATCGGCATGACCATCATCGCGCCGATCGCGGTG
CTCGCAGGCTTTACCATGGGGTTGGGTTGGGCGTCGTTGATTGTTGCGATCGTGATTTTT
GGCCTCGCGTGGGGTCTGAAGTGGTTGCCGGAGCGCGGACATGTCCGCGGCGAGGGTAAG
CCGCAA >RXA01667-downstream
TAAAGGTTGGAAGCGCCGGGTCT >RXA01722-upstream
CTCATTCCCCTCGCTAAAAGCTGCATAAAGTTTCGACGTTTTCAAAGTTGATTGCTTGCA
CTGTCGTTGCGTGTCGCATGCCCCGGCTATTGTTGATTGC >RXA01722
ATGCTCAGCACGATGCAGGACGTCCCACTGTCATTAACCAGAATCCTCGAGTACGGGTCC
ACTGTTCACGGTGATACTTTGATCACCACGTGGGCGGTGCCGATGGCATTGAACAAGCA
CAGCAAACTTTTAGTGCTGTGGGGGCTAGAGCTGCGGCTTTGGCTCATGCGCTGCATGAT
TCTTTAGGTATTACTGGGGATCAGCGAGTGGCGTCGATGCTCTATAACTGCGCGGAACAC
ATGGAAACTATGTTTGCAGTCGCATGCATGGGTGCCGTGTTTAATCCGCTGAACAAGCAG
TTGATGAATGATCAGATTGTGTTCATTCTCAATCACTCTGAAGCTGAAGTGGTTATCGCT
```

Attorney Docket No.: BGI-125CP

```
GATCCGCGCATGGCTGAACAATTGGGTGAGATCTTAAAAGAAACACCAAAAGTTCGTGCC
GTGGTGTTTATTGGACCGAATGATTTCTCTAGCGCGGCGGCCCACATGCCGGAGGGAATG
AAGCTGTATTCCTATGAAGCGCTCCTTGACGGCCGTTCCACTGTTTACAACTGGCCCGAG
CAGGATGAACGCACTGCTGCTGCAATTTGCTATTCCACCGGTACATCGGGACCGCCGAAG
GGTGTGGTGTATTCCCACCGCTCGCTTTATTTACAGTCGTTGAGCTTGCGCACCACGGAT
TCCCTCGCAGTGGAACACGGCGAAACGTTCCTGTGCTGTGTGCCGATTTACCACGTCCTC
AGCTGGGGCGTGCCGATCGCAGCGTTTATGTCCGGCACTCCCCTGGTGCTTCCTGGACCG
GATCTTTCTGCGCCGACATTGGCAAAGATCATTTCCACCACGCTGCCTCGCGTGGCGCAT
GGCGTGCCTACTCTCTGGATTCAGCTGATGGTTCACTACCTGAAAAATCCCCCAGAGCGT
ATGTCTCTGCGTGAGCTATACGTGGGCGGTTCTGCGGTGCCTCCAATCGTGATCACCATG
TGGGAGCAGCGCTATGGCGTGGATGTTGTCCACGTGTGGGGTATGACGGAAACCTCCACC
GTGGGTACTGTGTCTCGCCCACCATCAGGTGTTTCTGGTGAAAGCCGGTGGAATTATCGA
GTCTCCCAGGGCCGATTCCCCGCCTCCCTGCAGTACCGCATTGTCAACGACGGCCAGGTC
ATGGCGTCCACCGACCGCAACGAGGGCGAGATTCAGGTCCGCGGTCCGTGGGTGACTGCA
AGTTACTTCCACCCCGATGTGGAAAAAGAAGGTGGCACCGCCTCAACATTCCGCGACCAT
GACGTTGAAGAGGAAAACGATGAGCTCTTCACCGCCGACGGCTGGCTGCGCACCGGGGAC
GTTGGATCTGTCACCAGCGATGGATTCCTCACCATCCAAGACCGCGCCCGCGATGTCATC
CGTTCTGGCGGCGAGTGGATTTACTCCGCTCAGCTGGAAAACCTCATCGTGGCTACSGAA
GAGGTTGTCGAATGCGCCGTCATTGGCTTCCCCGATGACAAGTGGGTGGAACGTCCCCTC
GCAGTCACCATGCTCTACCCCGGCATTGAACGCACCCGGGAAACCGCCGAGCGCCTCCGC
GATCAACTTCGCGACCGCCTACCCAACTGGATGCTGCCAGAATATTGGACATTTGTTGAT
GAGGTGGATAAAACCTCCGTCGGTAAATATGACAAGAAGGACCTCCGCAACCACCTGCGC
AACGGCGATTTCGAAGTAATTAAGCTTAAAGGGCCAGGTGARAAA

>RXA01722-downstream
TAACTTCCCTATTTATTCCGGCT

>RXA01727-upstream
AGCTTTTGGTGGTTTCACCACCTGCGCTCGTCTTAATTTTGCGTGTTCCAGAGAGACCCT
TGAGGAGGGCTGCGCCGTATCGCCAGCGTGTTGTAAATA >RXA01727
ATGAGTAAAAAGTCTGTCCTGATTACTTCTTTGATGCTGTTTTCCATGTTCTTCGGAGCT
GGAAACCTCATCTTCCCGCCGATGCTTGGATTGTCGGCAGGAACCAACTATCTACCAGCT
ATCTTAGGATTTCTAGCAACGAGTGTTCTGCTCCCGGTGCTGGCGATTATCGCGGTGGTG
TTGTCGGGAGAAAATGTCAAGGACATGGCTTCTCGTGGCGGTAAGATCTTTGGCCTGGTG
TTTCCTATTGCTGCCTATTTGTCTATCGGCGCGTTTTACGCGCTGCCGAGGACTGGGGCG
GTGAGCTATTCGACGGCGGTTGGCGTCGATAATGCGCTTTATTCGGGCTTGTTTAACTTT
GTGTTTTTTGCGGTGGCACTGGCGTTGTCGTGGAATCCGAATGGCATTGCAGACAAGTTG
GGTAAGTGGCTCACGCCAGCGTTGCTCACGTTGATTGTGGTGCTGGTGGTGTTGTCGGTA
GCCAAGTTGGATGGCACGCCAGGTGAGCCAAGTAGTGCGTATGCGCAGCAGCCTGCGGGG
GCGGGTTTGCTTGAGGGCTACATGACGATGGATGCGATTGCTGCGTTGGCGTTTGGCATC
GTGGTGATTTCTGCGTTCAAGTACCAAAAGGTTAACAAGGTCCGCACGGCAACTGTCGTG
TCGCGCGTTCATTGCCGGAATTTTGTTGGCGCTGGTTTATCTTGGTTTGGGCTCAATCGGT
CAAGTAGTAAACGGTGAGTTCGCTGATGGCACCGCAATTTTGAACTACGCTGCACTGTCC
ACGATGGGTCAGGCTGGTCGCATCATGTTCGTGGCTATTTTGATCCTTGCATGTATGACC
ACCGCAGTTGGTCTGATCAGTGCGACGTCTGAGTTTTCAATTCGCTGCTGCCAGGTGTC
AAGTACCACGTCTGGGCCACTGTTTTCGCGCTGATTTCCTTTGGCGTTGCCACCATGGGT
TTGGATACGGTGTTGGCCGTTGCGGCTCCAGTGATTAGTTTCATTTACCCATCGGCCATC
ACCTTGGTGTTCTTGTCGCTCATCGAGCCCCTGCTGTTCCGTCTCAAGTGGACCTACCTA
TTCGGCATTTGGACTGCAGTTGTGTGGGCGCTGTTCATGTCTATCCCTGCGCTGAATCCA
TTCATCGAATGGGCGCCGCTGCACAGCATGTCTTTGGGTTGGGTTGTCCCAGTTCTCGTG
GCCTCTGCCATCGGTTTGGCTATTGATTGGAACAAGAAAGGTGCCCAGTCTGTTGCAAAG
AAGGAATCCATTTCCGTC >RXA01727-downstream
TAATCGCTAATTGCGAGGAGTCT >RXA01737-upstream
CTTTGAGCCGAACGATCTGCCGACTCAAGAAGAACTAGCCCGGCTGCTCAGTCAGGAATG
```

Appendix A, page 41

ATGCGCCTAAGATCAAACAAGAATGAAAGGACGGTGAACA

>RXA01737
ATGGGCCGAATGAAAAACGATGGTGAACTCGCGGATCTGCCGGATCATGCACTTTTGAGC
ATTATTCGAATCCCGCAGGCGGCGAAAAGAAGCCCCTGGGCGCTGATCTTAACGCGCATC
GGATACGCGATGGTGCTGCTGGTTATCGTCACCATGGTTGTCTATTTTGACCGCAACGGA
TACTCCGAAGACCTCACGTTCATCGACGCGTTGTACTATTCCACAGTCTCGTTGACCACC
GTGGGCTACGGCGATATCACCCCGGTGACGCAATCGGCACGCCTGATCAACATCATCGTC
CTCACCCCAGCACGCATCGGCTTCCTGATCCTCCTGGTCGGCACCACCTTGTCAGTGCTC
ACCGAAGAATCGCGCCGGGCCCTGCAAATCCAACGTTGGAGAAAACGCATGCGCAACCAC
ACCGTCGTTGTCGGATACGGAACCAAAGGTCGCTCCGCGGTCGCTGCACTGCTTGGCGAC
GGCGTCCCCGCCAACCAGATCGTTGTTATCGACACCGATCAAGTCTCCCTCGACGCCGCC
AACAACAGCGGACTCGTCACCGTCAAAGGCTCCGCCACCAAAGCAGATGTGTTGCGTCTA
GCTGGCGTGTCACGAGCGCGCGCCGTCGTCGTGGCACCGAACCTGGACGATACTGCAGTT
CTGGTGACTCTATCGGTGCGAGAAATCGCGCCGCAGGCAATGATTGTGGCCAGTGTCCGA
GAATCTGAAAACCAACACCTCCTCGAACAATCCGGTGCGGACTCGGTTGTGATCTCCTCA
GAAACCGCTGGCCGAATGCTCGGTCTGGCAACAGTTACCCCATCGGTTGTGGAGATGATG
GAAGACCTCCTCTCACCCGACGAAGGATTCTCCGTTGCCGAACGACTAGTCGGTGAGGAT
GAAATCGGCTCCAACCCACGACACCTCGCTGACATCGTCCTCGGTGTTGTTCGATCCGGT
GAGCTCTACCGCATCGACTCCCCAGAAGCAGAAACTGTAGAGCCCGGCGATCGTCTCCTT
TACGTTCGCCGAGTATTTAGCGAGGAGGTAAATGACAAA

>RXA01737-downstream
TGAGAATTCTTCCCATCGGCCCC

>RXA01755-upstream
TCGTTGGCTTACATGGTCATTGATGACCGGGCTGAATATGTGAGAAAATCCATCCCTTCT
TAAGCAAGGGAGTGAATTACAGAAAAGGATTGTTCAGCA >RXA01755
ATGAGCACACCTGACATTAAAGAAGGCTCGGCAGAATCACCGGGCGAAGTAATGGTCGTT
GGAGACAGGCGAGAGTGGCGTCGACAAGCAACCGGCATCATTGCCGGCCTCGTCTTAGCC
GCCCTGGTCTATCTTCTCTTCCCCTCGAACTCCGTGGAAACCGTCATGCAATCCAGTGGC
GTCGATCCAGAAACTGAATACACCAACAACGCGATGCGTCTTACTGCTGCAGTCACAATC
TTGATGGCAGTGTGGTGGATGACAGAAGCAATCCCACTAGCAGCAACCGCACTTATCCCG
TTGGTTGCATTCCCTGCTTTCCAGGTTGTGGACTTTGGGAAGGCAGCA >RXA01762-upstream
TGGAGTGATGAATTTTCCTATAGAACGTTTTTTAAACGATTGACTTTTTAAACGTTTACG
CTTTTAATGACTTCAAACGTGATCTAAAGCACAAAGGAGA >RXA01762
ATGAAAGTGAACCTCGGAATAGGAAGCTACCCACGACGCAGGGCAACTGTTCGACCAGAG
TCCACTGCAATCGAATTCGAAGGCACCAGCATCACCTACGGAGAATTCAGCAAACGAGTC
AATCGGCTTGGACATGCTCTTCTAGACCTCGGCGTTGCGCACCAAGATCGAGTAGCTTAT
GTCGGATTCAACCACCCTGCCCTGCTAGAAGTGTTCTTTTCAACGAACCTCATTGGGGCA
ACACCCGTGCTTGTTAACCCTCGCCTATCGGCAAACGAAATCGATTACATCATCCAAGAC
AGCGGTGCGAGCATCGTGTTTTACGGAATCGACCTCATCGAGCACGGCCACTTACCTCCAA
GAACTCCATCCAGAGATCATCATGGTGGCCGTTGAAGGCGATGAGGGTCCAGGTTTGCGT
CGAAAAGCGCTTATTGAAGCGGCGAGCGACGCCGACATCGACCTAGAAGTCAGCGATGAT
GACCTGGTGCTGCTCATGTACACCTCCGGAACCACTGGCCGCCCAAAGGGCGCCATGTTA
TCCCACCGAAACCTCTTCTTTAACTACTTCAATGCCCTGCTCAGCCAGGAAATTGAACAA
GGCGCGGTACTTTTATCCACTGCGCCGTTATTCCACATCGCGGGCCTCAACATGACCACC
ATCCCGGTGATGATGAAGGGCGGAAAGGTGATCATCCACCGCGAATTCCGGGCAGAGCAC
GTCCTCGACGAAATCGAACGCTCCAAGGTATCCGAATCCTTCATGGTGCCAGCCGATGATC
GACATGTTGTCCAACCACCCATCATTTGCCGAACGCGACCTTTCTTCCCTTCGCGCCATC
ATGGTGGGCGGCTCTCCCCTTAGCGAACGTGCGCTGCAATCTGGCAAGGACGCGACGTA
AAAATTGTCCAAGGCTTCGGCATGACAGAAACCGCACCGGGCGCCTGTATCCTCGAGGCA
ACAGACACAAGCACACACCTTGGAACCGCAGGTCGAGCCCACTTCTTCACCGACATCAAA
CTAGTGGACCCGAAAACCGGCGAAGAAGTCCCCACCGGAGAGGCCGGCGAAGTTCTCATC
CGCGGACCACATGTGATGACCGGATACTGGAACCGACCAGAAGACACCGCCAGCGCACTA Attorney Docket No.: BGI-125CP CAAAATGGCTGGTACCACTCCGGAGATATCGCCATCAAAGATGAAGACGGCTACTACACC
ATCAAAGACCGCATCAAAGACATGTACATCTCCGGCGGCGAAAACATTTACCCCGCAGAA
GTC >RXA01762-downstream
TAAGTACCC >RXA01764-upstream
TTTTCAAAATTAATAGTTGACATTTTCAACGTTATGAGTTTTCATTGGTATCACGCCCCG
ACGAAGTGTCTGGGATCACAAACCTTCAAAGGAGTTTGAA >RXA01764
ATGTCTCTCAATGGAAAAGTCGCCATCGTTACCGGATCTGGTGCAGGACTTGGTCGTTCC
TTCGCTCAGGAGCTTGCCCGTCAGGGTGCATCTGTCATCGTCAATGACGTAAACCAGGCA
GCCGCAGATGAGACTGTCGCAGCAATCACCGAAGCCGGCGGCAAAGCCGCCGCCGTTATC
GCCCCCGTTGGACCCTCTGAAAGCGCCGCATTGCTGGTGCGGGAGGCCGTCGACAAGTTC
GGTTCTTTGGACATTCTTGTCACAAACGCGGGCATCCTTCGTGATAGGTCCCTGCTGAAG
ATGACGGACGATGATTTCGATGCAGTCATTAACGTGCACCTCAAGGGCACTTTCACCTGT
GTTCGCGAGGCATTTGGATACTTCAAGGAGAATGGAATCGCGGGGCGCATCGTCACGATT
GGTTCTCCCACCGGGCAGCGCGGCAACTTCGGACAGAGCAATTACGCTGCAGCTAAGGCG
GGCATTGTGGGTATGGTTCGCACGTGGGCGCTGGAGATGAAGCGCGCAGGTGTCACCATT
AACGCGATCATTCCGGAAGCAGCCACCGATATGACCAAGACGGTGCCATATTTCCAGAAG
CTGTAGAGGCCGATGAGCGTGGCGAGGCCATGCCAGCATTCTTCCGCGAGACCCTAGGT
TTTGGCACTCCTCAGGATGTTGCGGGACTTGTGGCCTTCCTTTCCTCTGATGAGGCAGCG
AATATTTCTGGACAGGCCATCGGTGCAGGCGGCGACCGCATGCAGGTGTGGAAGCACCCA
GAGCCAGCAGTTACTGAATTTAACCCAGGTGGCTGGACCTATGAAGCACTGCAGGAACGT
GGCAAGAACATTATTGAGGGCAACCTGCAGTCCGTCGGTGTCGTTTTCCCTGAACTGCCG
GCAGAGCTTCAGCCACAAATCCCAGTCAAGGCA >RXA01764-downstream
TAACACCGCACACCAAGAATTTT >RXA01766-upstream
GATGAGGTTCGTCCGGGAATCCTCAAAGACAATGCGGTGAAGGTACTTGGCCTAGCCGCT
AGCACTGAGCGCGGATCTCAAGCAGAAAAGGTCGTGCAAC >RXA01766
ATGCGTGATCCCATTCAAGGTGCTGTTATTCCTTCTGATCTTTTTGGTTTCGCAGAAGTT
CTCACCGAAGCCGAACGCGCAGTTCTTCTGGAAACCCGCAGGGTGCTTGAGGAAGAGGTG
AAGCCTTATATTAATGAGGCCTGGGATAAGGCAGTCTTCCCCGATGAGATCGTGCAGCCC
CTCCAAGATCTGCAATTGCTTGATCCGCCTGCACTTCGGGAAGCAGGGGAGTCGGTTCGA
GACATTTTCACTGGTTTCCGCAATTTTGAACTCGCGCGCTGTGACATCAAT >RXA01801-upstream
TTTGGATTCCTTTCCGATTATGTCTTGATCGCCCATTCTGTCACATCCGGGTTGTCTAAA
CACCCGCGAAGATTTCCTGTGATGTGCCACACTGGTTCTC >RXA01801
ATGTCTAACGTAGTGAACACTTTTGTCCAGAATTCCACCGGTATGGTGGAGCTTAATCGT
CCCAAAGCGCTCAATTCTCTTAATCAGGAAATGATCGATCTCGTTCAGGAAGCTCTAACC
ACTTGGGCTGATGATGATCAGGTGCAGCAGGTTCTCATTTACTCATCCTCGGAGCGTGCA
TTTTGTGCCGGCGGTGATGTGCGCGCGGTCCGTGAGAGCGTGTTGGAGGGCGATGTTGCG
GCCGGCGATAAGTATTTCATCGATGAGTTCGCGATGAACAACACGTTGGGAACCTATCCG
AAGCCGGTCATTTCTGTGATCAACGGCGTCGCGATGGGTGGCGGAATGGGAATTTCCATG
CATGGATCGCACCGGATCGTCACGGAAAAAGCGTTCGCGTCGATGCCTGAGATGGCGATC
GGCTATGTTCCCGATGTGGGCTTTACTTATTTCGGTCAGCGTGCATCGTCGCTGGCCATC
GCCACATTTTTGGCGGTGACCGGGTGGCGCATGAGCCCTGCCGATATGCTGTGGGCTGGC
GTCGCAACGCATTTTGTTGAGGATGCGCAGGGGTTCATTGATGCGGTCTTGAACGAGTCG
CTTGATGGCGCGCTGGAGAAATTCTCCACGCAACCTACGGGCAGCAGCGAGCTGGCCGGC
GTCGCCAGCCAGATTGAGGAGACCTTTGGGCACAGCTCTTGGGCGCTTATCGACGCCTCC
CTCCGGTCTCACCCCGATGCTGAATTTGTTGCCAAGGTGGATGGGCTGATGGCGTCGGCA

```
GCACCGGCATCGGTGGTGGCTACCGTGAAGCTGATGCATCAAAACAGTGAGGCGACCACT
CTGCGTGAAGGCTTGGACAATGAATTGGCGATGTCTCTTTATATGATCCGCCAGCCTGAT
TTTGCTGAAGGTGTGCGTGCAGTGTTGGTTGATAAAGACCGCAATGCAGCCTTCTCCCCA
GCCAACTACGAAGATGTTGATGAGTCACATTTTGTGACCTTGTTCCAGCGCAGTTCA

>RXA01801-downstream
TAAAACCGCCAAACTTTTGATAG

>RXA01823-upstream
GCAACACGTTGATACTGAGCTGCACACGCCCGTTGGCCTGGTGACCAGTTTGCTGGGCGG
GGTGTATTTGATGTGGCTTTTGAGCCGAAAGGAGGCATAA >RXA01823
ATGCTGCAAGCGCATGATCTCACGCTGAGTTACGGCGGGCGAAATATTGTAGAAGGGCTC
AGTCTGGACCTTCCGGAAAGAGGCCTCAGCATCATCATTGGCCCCAACGGATGCGGGAAA
TCAACCGTTTTGAAAGCGTTGGGCAGACTGCTGAAACCACAATTGGGGAAGATCACGCTA
GGTGGGCGAGATATTTCCAGCATGGGCACCAAGCATGTGGCGAAACACATCGGGGTGCTT
CCGCAACCCCCATATGCGCCCGATGGGGTGAGCGTCACGGAGCTGGTCAGCCGCGGGCGG
TATCCGCACCAACATCTGCTGTCGCAATGGTCGAAAGACGATGAAGCCATTGTGGCGCGC
TCGCTGGCGGAAGTCGGCATGCACACCCATGCTGAGCATTTAGTGTCGGAACTTTCAGGC
GGCCAGCGCCAACGGGCGTGGATCGCCATGGCGCTCGCTCAGGAAACAGACATTTTGCTT
CTCGACGAGCCCACCACGTTCCTCGACGTAGCCCACCAAATATCCGTCCTCGATTTATGC
TCCGACCTGCACCAACGTGGTCGCACCCTGGCCATTGTTCTACACGATCTGAACATGGCT
GCACGGTATGCCACCCACATCATCGCCATGCGGGACGGCACCATCATCGACCAAGGAAAA
CCCGAAGAAATACTCACTAAAGCGCTGCTCAAAGAAGTTTTTGACCTCGACGCACTCATC
CTCAAAGACCCCAACAACGGCCGACCACTCATCGTGCCCACAGACAGGAGAAACTCA >RXA01823-downstream
TGAAAGAAACCGACAACCTACTG >RXA01833-upstream
AAATATACCCCCCAGGGTATCTTGACAGATTAAAGCTCGATGTTTTAGGCTCTACATATA
CCCCCACGGGTATCCCCTCAACTTTGATCTAAGGTGTCAC >RXA01833
ATGCTTTTTGAACGCATCTACGAAGAAGGCCTCGCCCAAGCCAGCTATTTCATTGGCTGC
CAACGCGAAGGCAAAGCGATTGTTGTTGATGCTCGCCGAGATATCCAGACCTATCTGGAC
CTTGCAGCAAAAAACAACATGGTCATTAGCGCCGTAACCGAAACCCATATTCATGCCGAT
TATCTCTCCGGTACTCGCGAACTTGCAGCTGCCACCGGCGCCGAGATTTTCCTCTCTGGC
GAAGGCGGAGCTGATTGGCAATATGGCTTTACAGGCACCACCTTGATGCACAATTCCACC
ATCAAGCTGGAAAATATCACCATCACAGCCAAGCACACTCCCGGACACACTCCAGAGCAC
CTGTCATTTTTGATTACTGATGGTGCGGTCTCAAAGGATCCCGGTTTTATGCTCAGCGGT
GACTTCGTCTTCGTAGGTGACGTGGGACGTCCAGATTTACTTGATGAGGCAGCTGGCGGC
GTGGACACCCGCTTCGCCGGAGCACAGCAACTCTTCCATAGCCTAAAAGAGCAGTTCCTT
GCACTCCCCGACCACATTCAGGTTTATCCAGGTCATGGTGCTGGCAGCCCTTGTGGCAAG
GCATTGGGCGCGATCCCTAGCACCACCGTGGGATATGAAAAGGCTAATGCGTGGTGGGCT
CCATATCTGCGCAGTGATGATGAAGCCGGCTTTGTGGAAGAGCTTCTCGACGGCCAGCCA
GATGCCCACGCTTACTTTGCTCGCATGAAAAAGCAGAACAAGCAGGGACCTGCAGTACTT
AGTACATTATCCCCGCTTGTGAAGCTAGAAGCCGAGGAAGTCGTCGAAAAGCTTGGTTCT
GAAGCAGTATTTGTGGATACCCGCGAGCAAACCAAGTCCATCTCGGAACCGTTGTTGGG
GCATTGAATATTCCGCGCGGCGCCAAGGCGTCCAATTTTGCGGCGTGGGTTATTGATCCT
CAAAAGGATGCTCAGGACCTTATTGTTTTGGCTCCGGACGCCAATACCGCTGCGGATTTC
CGCGACGCTTTGCTGCGGGTTGGCATCGACACTGTGCGTTATTTCACCAACAGTATCGAT
GGATTGCCTACCTTTGTGCCAGAACTCATCTCCCCCGCTGAGCTAGCTGAGACCAACTAT
GACGCACTGATTGATATCCGTGCAAAGTCCGAATTTGCCGCTGGCAGCATTCCCGGCGCG
CAGCAGCTTTCTGGAGGTTCGGCCATGTGGCGCCTCAATGAGCTGCCTGCGGGTGGCACT
TTGGTAACCTTCTGCCAATCAGGAGCGCGAAATACCGTGGTAGCCAATGCTTTGCGACGC
GCCGGATTCACCGTTATCGAGCTCGAGGGCAGCTACGCCGCGTGGGAAAAATCAGCTGCC
AATCCTAAAAACTTGCAGACTGCCGTC >RXA01833-downstream
```

Attorney Docket No.: BGI-125CP

TAGTTTTAGATCCGGCGCTGTAT

>RXA01853-upstream
GAATGTCCAACGTCAAAAAAATTCTTTTCTATCCTAACCGTATCTTCACACCTTGAGGGA
ATGATGGGGAGCGCCGCTTACGCACTACACTGTTTATTC >RXA01853
ATGGAGATCCTCGGATTCGCGGCTGGTCCGTATAAAACAAATTGCTATGTGGTGCGCGGG
GAGAATGAGGTCGCGATCATTGATCCTGGCATGCATGCCCACGATGATTTGGTGGAATAC
ATCACCACGAATAATTTGAGCGTGGACAAGATTGTGCTCACCCACGGACACATTGATCAC
ACCCGTGATGCTGGTGTTGTGGCAAAGCGTTTCAATGCGCCGGTCTATATCCATCCTGAT
GATGCGTTTTTCCTTGAGGTCTACAAGGGATCTGGAACAAAGACGGCCATGCTTTTCGAC
GCCGACAACATGGTGTCCCCTGATCCTGAGTCACTGCGTGATCTGGTTGATGGTGAGACA
ATCACTTTGGCTGGCGAAGAATTCACGTTGAAGCATGCACCAGGGCATTCACCTGGTTGT
ACGCTGATCGTCGGCAAGGAATACTGCTTTAGCGGTGATGTGTTGTTCAAGGGCTCTATT
GGTCGCACTGATTTTGAGTGGTCTGATGCAGATGCCATGAATGAGTCACTACGCACGGCA
GTGCTCCCACTT >RXA01853-downstream
TGATGATGCATTGCAGATTCTTC >RXA01881-upstream
ACCGGCCCTGCGGCCTCAACCGCCGACCAGCGCGGCGCACACATTTTGACTGTTTCATAA
TAAAGACAAACTTAAGTATCGGAGTCGAAGAAAAACCACA >RXA01881
ATGGCCAATCTGATTAATCTCGAGAACGTCTCCAAAACCTGGGGATTAAAAACGCTTCTC
GACGGTGTCTCCTTAGGTGTTCAAACCGGCGACCGCATTGGCGTCGTCGGCCTCAATGGT
GGCGGAAAAACCACCCTGCTGGAAGTACTTACTGGCATCGAAAAGCCGGATCAGGGCCGT
GTGTCTCACAACTCTGACCTGCGCATGGCTGTGGTGACGCAGCGTGCTGAACTCAATGAT
GACGACACCGTCGCTGACGTGGTGCTTGGACCTTTGGGTTTGGAAGTTTTCGAATGGGCA
TCAAACGCCACGGTGCGCGACGTCCTCGGTGGCTTGGGCATTGTCGATCTTGGCCTTGAC
ACCAAGGTGGGGCAAACCTTTTCCGGTGGGCGAAGCGCCGACGCACCAACCTGGCCGCCG
CGCTGGTTCGCGACCTTGACC >RXA01881-downstream
TGATCGTGCTCGACGAGCCCACC >RXA01894-upstream
AGAATTTTTTCGAAAATGCTGGCACCATCAACAGTGACATTGTTAGAAACTTCAAGGAGA
ACCCATGAATGAACCGGAGCAACATCACCGGTCCATGAGG >RXA01894
ATGCCCAAACCCAAAAATAATGCGGGTCGAGATCTCAAAGCTGCCATTGCTGTGGGGATC
GGACTGGGGGTCCTGGTTCTTTTGGGGATTGTCCTAAGCCCATGGGGTTGGTACATCCTC
GTTGCAGGTTTTATGGCTGCAGCAACATGGGAAGTTGGTAGCAGACTTAAAGAAGGCGGC
TATCATTTGCCACTGCCGATTATGATCATCGGCGGTCAGGCAATCATCTGGCTGTCATGG
CCATTTGGCACGATGGGCATTTTGGCGTCTTTTGTGGCCACTGTGTTGGTGCTGATGTAT
TTCCGAATTTTCTACAATGGCACGGAAAAAGAAGCCCGCAACTATTTGAGGGACACCTCT
GTGGGCATCTTCGTGCTCACCTGGATTCCATTGTTCGGAAGCTTCGCTGCGATGCTGTCG
CTGATGCAAAACAATTCCATCCCGGGTACATATTTCATTTTGACGTTCATGCTGTGTGTG
ATCGCATCGGATGTGGGCGGGTATATCGCGGGTGTGTTCTTTGGATCGCACCCAATGGCG
CCGTTGGTGAGTCCGAAGAAGTCTTGGGAAGGCTTTGCCGGCTCCATTGTCTTAGGATCG
GTCACTGGTGCACTCAGTGTTCACTTCCTGCTCGATCACCACTGGTGGATGGGTGTGATC
TTGGGTTGTGCCCTAGTTGTGTGCGCCACGTTGGGTGACTTGGTTGAGTCGCAGTTCAAA
CGCGATTTGGGCATCAAGGATATGTCGAACCTTCTTCCAGGCCACGGCGGATTGATGGAC
CGTTTGGATGGCATGCTCCCGGCCGCGATGGTGACGTGGTTGATCCTGAGTGTGATCAGC
AGCTCGTATCCGTCG >RXA01894-downstream
TAAAGCTTGGGCCAGCTTTAAGT Appendix A, page 45

Attorney Docket No.: BGI-125CP

>RXA01897-upstream
CTATTTAGATCGTTCCGGAACCGATCCACGCGCCGATATCCACTCCCTGGATGAACTCTT
TCACTAGGCTGGCCTTTATTGTTTCCGGAAAGGGGTTGCT >RXA01897
ATGAAAATTGGTGTCATCCTGGGCAGTATCCGCGAAGGCCGCTTCGGCCAAGGCGTTGCC
GATTGGGTCATGGAACAAATCGGGGCTTATGACGCACCCGATGTGGAATTTGAACTCATC
GACCTCAAAGCTTTCAACGTGCCCCTGTTGGAATCCGCGACAGTTCCAGGTTCCGCGGAT
AAACAGTACGACGACCCGCGCGTAACTGCCTGGTCACAGGCCATTGATGCCTGCGATGCC
TTCCTTTTCATCACCCCGGAATACAACCACGGTGTGCCCGGCGCGTTCAAAAATGCGTAT
GACATCCTGGGCAATGAATGGCTGAACAAAACCGTCGGTTTCATTTCCTACGGTGCAGTC
GAAGGGATCCGTGTTGTCGAACAGTGGCGTCAGATCGTCGCCACCTTCAACATGTACGAT
ATCCGCAGCCAGCTATCCTTTTCCACCTTCACCGAGAACAACAACGGCACTTTTGCGCCC
AATGATCGACGCCCCGGTGAACTAATCCGCCTCCTTGATAGCCTCCTAACGGCTGTCCGC
GAT >RXA01897-downstream
TAAGGCTCTGAAATACTAATGAG >RXA01946
ATCCGCAAGTACTCCAGGCTCGAGGAACAATTCCAGTCGCTCGGCGGCTACGAAGCTGAC
GCCGAAGCAGCCCAGATCTGCGACAACCTCGGCCTCGAGGCACGCATCCTCGACCAGCAG
CTTAAAACCCTGTCCGGCGGCCAGCGCCGCCGCGTCGAGTTGGCGCAGATCCTCTTCGCC
GCCACCAACGGCTCCGGCAAATCAAAAACCACATTGCTTCTCGACGAGCCCACCAACCAC
TTGGACGCAGACTCGATCACCTGGCTCCGTGACTTCCTGGCGAAGCACGAAGGTGGACTG
ATCATGATTTCGCACGACGTCGAACTGCTTGGCGCCGTATGTAACAAGATTTGGTACCTC
GACGCAGTACGCAGCGAAGCCGATGTCTACAACATGGGCTTTAGCAAATACGTCGATGCA
CGTGCACTCGATGAAGCACGCCGACGCCGTGAGCGCGCAAACGCCGAAAAGAAGGCCGGA
GCCCTCAAGGACCAGGCTGCACGCCTCGGCGCGAAAGCAACCAAGGCTGCCGCAGCTAAG
CAGATGATCGCCCGTGCGGAACGAATGATCGACAACCTCGACGAAATCCGCGTAGCTGAC
CGCGCCGCCAACATCGTTTTCCCAGAACCAGCACCCTGTGGAAAAACCCCACTCAACGCC
AAGGGCCTGACCAAGATGTACGGCTCCCTCGAAGTCTTCGCCGGCGTCGACCTAGCCATC
GACAAAGGCTCCCGCGTAGTCGTCCTCGGATTCAACGGTGCAGGTAAAACCACCCTGCTC
AAACTCCTCGCCGGTGTGGAACGCACCGACGGCGAAGGCGGCATCGTCACCGGATACGGC
CTCAAAATCGGCTACTTCGCCCAGGAACACGACACCATCGACCCCGACAAATCCGTCTGG
CAAAACACCATCGAAGCCTGCGCCGACGCCGACCAACAAAGCCTCCGCAGCCTCCTCGGA
TCCTTCATGTTCTCCGGCGAACAACTCGACCAACCAGCAGGAACACTCTCCGGCGGTGAA
AAAACCCGCCTCGCACTGGCCACCCTCGTGTCCTCCCGCGCAAACGTCCTGCTTCTCGAC
GAGCCCACCAACAACCTTGACCCGATCTCCCGCGAACAGGTCCTCGACGCACTGCGCACC
TACACCGGCGCAGTCGTCCTGGTTACCCACGACCCGGGTGCAGTCAAGGCCCTTGAGCCA
GAACGCGTCATCGTGCTTCCTGATGGCACCGAGGATCTTTGGAATGATCAGTACATGGAA
ATCGTGGAATTGGCG >RXA01946-downstream
TAGGTTCTAAGGCTGTTTATGCT >RXA01980-upstream
AGGATCGTACCAAATAAGGCAATAAACTCTTTTTACTTTTCCTCAACTTCCTGAAAAGTC
GCCGCCCTAGAATTCACTAAGTTTCCGATATCTTTAACCC >RXA01980
ATGCAGATCATTGATCTCTCTCATGCGTTCGCGCCCGGACAACCCCACTACCCTGGGGAT
CCAGATCAAGAAATTAAGACGGTCTCCACGATTGAAAACGATGGCTTTTTAATGCATCAA
TACAGACTTGTTGGTCCCTGGGGAACGCATGTAGATGCACCTGCACATTTCGATCCACAA
GGTCGGACGCTTGATCAGATCCCTGTGGAGGAAACGCATTTACCCCTTTATTGCCTGAGG
TTTTCTCGCCCCGATCTATGTACTGCTGCTGATATAGAAGCGTTTGAACATACACACGGG
AAAATCGAACCAGGATCCTTCGTCGCACTCCACACTGGATGGGAATGGGGTAAACAAGGG
ATCGCACCCGGCTGGTCTATCGAGGCTTTAGAAATCCTCCATGCCCGTGGAGTCATTGCC
ATTGGCCACGATCTTCCCGATACAGATCCTTCACTGGAGGCACAGCGCTGGTGGCTGTGC
CGTGACCATTGGCAGATTGAAAAACCTCACCAATTTGGACAAGGTTCCTGCAACGGGTGCG Appendix A, page 46

Attorney Docket No.: BGI-125CP

```
ATGATTGCTTGTCCTTGGCCAGTTCCAAAAGATGGTGCTAGTTTCCCAGTGCGTCCAATT
GCTCTCGTCCCAGAGCACCTATCCCCTACTCGC

>RXA01980-downstream
TAAAGCGAACGGCAGCACCTTCT

>RXA01983-upstream
ATATCGCTGCCATGGCAGCCTTGCTGGGCAACCTCAAGCACACTGACCTAGAAGAGCTCC
CCACCGATTACCAGGGGTGTCCTCCCATGTCCGCTGCGTT >RXA01983
ATGGAAGGCTACGGACCTACCCAGATCGAAAAGCTCTTACCTGCATACACACAGGTCAAC
ACAGCCGGGAATAATCCAGCGACGACGCCTGAGCAAGATCTCCTCGGCGGAGCTGCAACC
TCGCCGGAAAACTACGACCACCAGCTGCAGTACGCAGTCGACGCCAGTCCGGTGCATCAG
AATGCGGCACAGGCACCGCCCTTCCTGATCATGCACGGCACTGGTGACCGGATGGTCCCT
CCGGAGCAATCGGCTGCGCTGCACACCCATCTTGTGCAGGCTGGTCGGCAGTCCACCCTG
GTACTCATTGAGGGCTTTGGCCACGGTTTCCTCAATCCCGGGGAAGTCGCGGAGCTGGGG
CCAAACGTTCGACTAGACAATGGTCGGCTCGAGCGGGAGCCTCAGACAAATTTCAGCGCG
CAGCAGAGTCCGGGAAACCCCTTTGAACTACAGGGACTTGCCGCCGACCATGAGATGATC
AAGCGCTTTTTCACCCTGCACCTTCGC >RXA01983-downstream
TAAGACTCTACCTTCACCCAACT >RXA02020-upstream
TTGGTCAATCAAGCGTGAATCCGGCTTCCATGAGCCAGTTGCCCGCCTCAAAGCTTGACC
CATTTTCATAACCAGTGCCATGTGGGTTTACGGTTGATAC >RXA02020
ATGGCTAAATCTAATGAAGGGCTGGGAACCGGACTTCGGACCCGCCACCTCACAATGATG
GGACTCGGCTCCGCAATTGGTGCCGGACTGTTCCTCGGCACCGGCGTTGGTATCCGCGCA
GCCGGCCCCGCAGTGCTCCTGGCGTACATCATCGCCGGAGCCATCGTTGTGCTTGTTATG
CAAATGCTCGGCGAGATGGCTGCTGCCCGTCCCGCCTCCGGATCGTTTTCACGTTACGGC
GAGGATGCTTTCGGCCACTGGGCTGGTTTCTCCCTCGGTTGGTTGTACTGGTTCATGCTG
ATTATGGTGATGGGCGCCGAAATGACTGGCGCTGCTGCCATCATGGGTGCATGGTTCGGC
GTCGAACCGTGGATTCCTTCGCTTGTCTGCGTGGTCTTCTTCGCTGTGGTGAACCTCGTC
GCGGTTCGCGGTTTCGGTGAATTCGAGTACTGGTTCGCATTCATTAAGGTCGCGGTGATC
ATCGCTTTCCTCATCATTGGTATTGCTCTTATTTTCGGATGGCTTCCCGGATCCACCTTT
GTTGGAACCTCAAACTTCATCGGTGATCACGGATTCATGCCCAATGGTATTTCTGGTGTT
GCTGCTGGTTTGCTCGCGGTGGCTTTTGCCTTTGGTGGCATTGAAATTGTCACCATTGCA
GCTGCAGAGTCCGATAAGCCACGTGAAGCTATTTCCCTGGCGGTGCGTGCCGTGATTTGG
CGTATTTCAGTCTTTTACTTGGGCTCTGTTTTGGTCATCACTTTCCTCATGCCTTATGAG
TCGATCAATGGTGCCGACACCGCTGCGGAATCCCCCTTCACCCAAATCCTGGCGATGGCA
AACATCCCTGGCACGGTTGGTTTCATGGAAGCGATCATCGTTCTAGCACTGCTTTCCGCT
TTCAACGCCCAAATCTATGCCACTTCTCGTTTGGTATTTTCCATGGCGAATCGACAAGAC
GCTCCGCGAGTTTTCAGTAAGCTCAGCACCAGCCACGTCCCCACCAATGCG >RXA02029-upstream
CGCACGTACACTACTTTTAGCAGTTAACCCGCCGAACTTTCTTGATTAAGTATTCATTGA
GCGTTCTTGGCATAAATCCCACTGGAGGTGCATCAAACGT >RXA02029
ATGGCAGAGGCACGTTTGCGCCATCTTGAACCCATTGATGTGGAAGAGTGGCCTGGGGTG
GCGTCAGTGCCCAACCTAGCGTTTGCTGGTGCACGCGCACGGCAAGCAGAATATCGATTT
GCCAAGGCCTGCAGCAACGCAGGTTTAGTTCTGCTAGGAAATGACCCGGATCTCATTATT
GATCATGAGGAATTATTCTCACGTTTGCCGCATCGGGCTGGCTGGGGCTCGCTGAGAGC
TACATGGCAGGCGAGTGGCGCAGCGAGAGGCTTGCCGACGTCTTGACCGCTTTGTTGGGA
ACTGGGTTTAAACCCCGCGGCAAACTATCTGGATCGTTCACCCTGCCAGGGCAAGCTGTG
GATGCCGGAGGCGCACTACCCAATGAACTCATTCGTTTAAGTTCAGGTGATGGCATGAGC
GCATTTGGTGGAGTTTTTGCCTCCGGTGTTCCAACCACTTTACGTACCGCAGTGAAAAGC
CATGTGCCGGGAGCTGGTCGCAATAGGGAGCCCGCATCTCACTTTGTGGATATCACCAAG
```

Appendix A, page 47

Attorney Docket No.: BGI-125CP

```
ATCTCGGAGCCTGTGGCCGTGGAGCGTGAAGACCTCGGCGAGGCTCAGCGCCGAGCAGCG
TCCTTTTTGCTTGACGGCGCCAAAGTTAAAGCCGGAAGCCATGTGTTGGAGTTTCCCAGC
AGTGGTGGAGCTTTAGCTATTTTGGCTGCTCGACGCCAGGGAACTGTTGACGCTTTAACG
GCTGATCCCGCGCAAGTTTCAAGCCTGGAGGAGACGTTTGTGCTCGCCGGTGTGGAGGAG
GATATTCACATCGAGGTCATTCCCCAGGCGATTCCCTCGCCACGCGAATGGGGTGGCGCC
TACGATTCGATAGTCGCCATGGAGAAGCTAGAAGTGGTGGGCAAGCACGGTTCCAAGCGG
TTTATTAAAGCTATCGACAGAATGCTCACCACCGGCGGCAACGTAGCCATGCAATCCTTG
GTAGCTACTGACCAATGGAGTCCTGTGTGTTCTGAAGCGATTTCTTTGCTCAAGGCCTAT
ATTTGGCCTGCGCTGCATTACCCAACTGTTGATGAAGTTCATCAGCTTGTTGATAGGGAT
TCTTCTCTGCGCGTGGTGAAGGAAACACACTTTGCGGGCCATTACCTAAAAAGCGTGCAG
TTGCAACGTGAAGTGTTTGAAGGCCAGATACGCGAAGCGGCGGCAGATGGCTTTGATGCC
GTCTACCGCCGCATGGGGTGTATCACTACGCGCTTATTGAAGCCCTGTTACGCCTGGGA
TGTCTCAATGCAGTGCAATTTGCGTTGACGACAAGAAACAGAAGGGGGCGTCGA

>RXA02029-downstream
TAAGCAAAAATCTTTTAGACCTC

>RXA02030-upstream
GCGCCTAACATCTCATTGTATGGGATTGACTCTAATAATCTCCTGTGGAAACATCGCAAG
GGTAATTATTGGAATCTATTATTGTGTGAGGCGATAACTC >RXA02030
GTGACCACAACTGATCACTCCACGGAGTTGAATCCTTCTGATCCAGGTGGGCAGACGGCA
ACCCTAGTGATTGACAAGAAAACTAAACGTCGGGTTGCAGCAGCCTCCACCATCGGCACA
ACCATCGAGTTCTACGATTTTTATGCGTACGCTGCGGCAGCTGTCGTTGTTTTCCCAAGT
CTGTTTTTCCCTGCCAATGACAACCCAACCGTGAACCTGTTGGCATCGTTTGCCACCTTT
GGTCTTGCGTTCGTTGCTCGTCCACTCGGTTCAATCATTTTCGGGCACTTCGGTGACCGT
GTGGGACGCAAAGCTACCTTGATCGGTTCACTGCTGACCATGGGCATTGCCACCATCTTG
ATCGGCCTGCTGCCTACTTATGGTCAGGTCGGAATCATTGCACCGGCGCTGTTGGCGCTC
ATGCGTTTCTGCCAGGGCCTGGGCCTTGGCGGTGAATGGTCTGGCGCTGCGTTGCTGGCT
GGTGAAAACGCGGAAAACACTCACCGCGCTCGTGCTGCAATGTGGCCACAGCTGGGTGCA
CCGTTTGGTTTCTTCTTGGCCAATGGTTTCATGCTCATTCTGGTCGGTGTGCTTGCCCAT
CAGGACGGCGATCTTCACGGCGCGTTCATGACCTGGGGTTGGCGTCTGCCATTCCTGTCT
TCGGCGATCATGATCGCAGTTGGCCTGTGGGTGCGTTTCTCACTGGAGGAAACTCCAGTG
TTCAAGCAGGCTGTTGATCAGGGCAAGAAGGTGAAGTCTCCGCTCAAGGAGCTGTTCAAG
ACTTCCCCTGGCCCTGTTGTGCAGGCTACTTTGATCATGCTGTCCACTTATACCTTGTTC
TACCTGGTTACCACGTGGATTCTGTCGTATGGCATCGGTAATCGCAGCACCGGAAACGGC
CTGTCTATTCCGTACTTTGAGTTCTTGCAGTTGCAGCTGGCCACCATCGTGTTCTTCGCC
ATCATGATCCCTGTGTCAGGCTGGTTGGCTGATGTGTGGGGTCGTAAAAACACCCTGACC
TTGGCTTCTGTGCTGCTTCTCGGCTTTGGTCTGACGTTTAATCTGCTTCTCGATCCAGAG
ACCGCCACCAAGACCACCGTGTTCATCTTCTTGTTCGTGGGCATGAGCATCATGGGTCTG
ATCTTTGGACCCATGTCGGCAATTTTGCCGGAGCTCTTCCCCACCAACGTCCGCTACACG
GGCTCCGGAATCGCCTACAATGTCTCCTCGATCCTCGGTGCAGCTATTGCACCGTTCATC
GCAACGTGGCTGGTGTCCGAGTTTTCAGTGGCGTACGTCGGCTATTACCTCATCATCGTC
ACCGCAATTACCTTTGTTGCGGTGCTGACGATGAAGGAAAACAAAAACCACGACCTCCGA
GAGGTC >RXA02030-downstream
TAAAAGATTTTTGCTTATCGACG >RXA02073-upstream
TCATTGTTTTAGAGGATGGCCAATTGACCATGATGGATACACCCAGCAACGTTTCCCAGC
ACAATGCGTTTTTCCGCACCGCTGTGATGGAGGAAGAACA >RXA02073
ATGATTTCCCGACTTCTCCAATTGGCTAAGAAAGTATGGCCGGAACTTGGAGCCTCCACG
CTCCTGCGACTGCTCAATCAGCTACTCACCGCAGCACTCATTGTGTTCCCCGCCTGGGTG
CTAAGCCGCAAACCAGACATCTCCCTGCTCGCCGTCGCCATCATCATGGCGCTCATCGCG
CTGACAGCAGCTGTCTGTCGCTGGGGTGAGCAGGTATGCGGCCACCGCGCTGCCTTTGGG
CTGCTTGCCCACATGCGCGTTATGCTTTACGACGCCCTCGTCCACAAAGGTTCCCCCTCG
CCGATCCACGGCAGCGGTTCGATCATGTCTGTTGCCACCCGTGACATTAACTCCATCGAA
```

Appendix A, page 48

Attorney Docket No.: BGI-125CP

```
GTATTCTTCGCGCACACCATTGGGCCTACAGTCACCGCAGTGCTGCTCAGTGCGGGAGGC
GTGATCACGCTGGCAACGCTCGATCCCGTTGCTGGTCTAATTGGTTTACTCGGTGTCCTC
ATCGCGTGGTTGATCCCCTTGATTGGAAAACAATCCTCAAGCAGTGAAGCCACATCACGT
GGACACATCGCCCAGCACCTCACCGAAGATGCCGCCGGCAGGCTTGAAATCAACTCACAT
GGAGCGCAAGCCACACGGTTAAATGCGCTCGAGGTGAAAGAGCAACAACTGGAACAAGTT
GTGACCCGACAGGGCTTGATCGTCGGTATCCGTCAGGGCGCAGCACTTTTATGGCCGTGG
ATATCAGCTGTGTTGTTGGTTGCTCTGGTTCCTCATGTGGGCATTGTTGCAGCCGCGATT
ATCCTGGGCATCTCCCCTGCGTTGGATGCAGTTGAGGGATTTGCTCGCACCATGCCTACC
GCGTTAAACAGTGCGCAGCGGTATTTCCAGATCATCGATGCCCCTGTTGCTATCGCTGAA
CCTGACGAGCCGAAGCCTTTGCCCAAAGGCCCGCTTAAGCTGCGAATTTCTAGAGTTCCA
GTCAGCGCAAAGGGCACCGTGTCTTTAGAGGTTGCAGCTGGTGAACACATCGGCATCATC
GGATCCAGCGGTAGTGGAAAATCCACTTTGGCCAAACTCATCCTCAAGCTGGCCGCAACTA
CGGTCTGGAACCATCACCATCGGTGGTGTTGATATCGCAGAGGTTTCATCGGCGGAGCTT
CGCAAATCCGTCACGCTGGTTGAGCAGAAATCTGTGCTGTTTAGAGCAAGCGTGCTGGAG
AATTTACGGATGGGCAATCCAGAGCTGTCTGAAGATGAAGCAAGGGAAGCCTTGAGGTTG
GCGTCGATAAGCGAACTGCCTTTAGATGCTGACGCCCTGCGCCTATCTGGCGGACAGCAA
CAACGGCTCTGCCTGGCGCGTGCTTTGGCACGCACCCCTCAGGTACTGATTGTCGATGAA
GCCACCAGCCACCAAGATGCGCTCAATCAAGCGGATCTTTCCCAGACTCTGGCCACGCTT
AAAGACACCACGGTGATCATCATTGCGCACCGCACAGCTGCATTAACCCATGTGGATCGG
ATAATTGACCTGGAAGAAATCAAAAATCCC

>RXA02073-downstream
TGATCCTTAACGCGGATCAGGGG

>RXA02074-upstream
CGGGGGAAGGCCGTGTCGCATGCTCGGGCTAGCCTTGGATCTCAAGAAGAATTCGACTGG
TTTAAAGTCTGGGCTTTAAGTGCAGAAAGGTTGTGGATTG >RXA02074
ATGCGCTCCCTGCTTCGTGATATCCCTGCGGTGGGTTGGCTAATCACCGCGACGATTGTT
GTGCGCACGCTCGTTGTTGCGCTGGTCATCGTTGGGATCGGCTTGCTTATCGACGTCCCC
TCGCCCGCTCATTCAGCCATGTTGTGGTGGGTTCTGGCAGGTGCCACGGCAGCAGCTGCG
CTGCTGTGCGCGGAAGCGGTGCTCCCCAACGTATTCGTGCACGAGTTGAACGATCCTGG
CGGCGGCAGTTGGCTGCTAAAAATCTGGAGCTGAATTCCAGTTCGTCAGATGATGCCCAG
TTGATCACACTGGCAACTGAAGCCACCTCAAAAGCATCCACTTACACAGTGATGTTTCTG
GGGCCTTACTTTGCAGTATTTTTGGCCCCACTGACAGTTATTGCCGTTGTCGGCGCGGCT
ATTTCCTGGCCGATTGCGGGGATACTGTGCCTCGGGTTGTGCGTGATACCTTTCGTTATT
TCTTGGGCACAGCGCATGTTGAAAGGCGCTGGCGCGGGATACGGGCGAGCATCTGGGCAG
TTGGCAGGCGTGTTTTTGGAATCGGTGCGCACACTAGGCACCACGATGATGCTGAATGCC
GCTGGGCAGCGCAGGCAGATCATCACACAGCGCGCAGAGAATATGCGCTCCCAAGTGATG
TCATTGCTGTACCGAAATCAGTTGATGATTCTGGTGACCGACGGCGTGTTTGGAGTTGCC
ACCACAATGGTTGCTGCGGTGTTTGCCATTGGAGGATTCTTTTCAGGCTCTCTTACTCTC
GGCCAAGCTGTAGCACTCGTATTGCTGGCCAGGCTGCTTATTGATCCCATCAACCGCATG
GGTCGCACGTTTTACACCGGCATGGCAGGCAAACCCTCGCTGATCGCCATTGAAAAAGCC
CTCGCGACAACCTTTACTGATCAGCCAACTCAACAGGGACAGCGCCACGATGGGGATCTG
GTGGTCAACAACTTGAAGATCGCCCGCGATCACAGGGACATTGTGCACGGTATCTCTTTC
AGCATTCCCCGCGGTTCCCACATCGCGGTGGTAGGTCCCAGTGGCGCTGGTAAATCCTCT
GTGGCTCTAGCGTTGTCCGGACTTTTAGAGTTTGATGGTGCGATTTCCCTCGGCGGCCAC
AACTGTGAGATGTTAGATCTTCGCGCCTCAGTCAGTTTCGTGCCCCAATCCCCACGCTG
TTTAGCGGAAGCATCAAAAGCAATATCGATCTGGCGCGCACGGGTGTTGATTCTGATCAC
ATCCACGCAGCACTTTTAGGCGAAGAACTCCCCGCGGACCTCAAAGTCGGTGAAACCGGC
AAAGGTGTCTCCGGCGGCCAAGCAGCACGCATTTCCATTGCCCGAGGTTTAGTAAAGAAT
GCTGCCGTGATTGTTCTCGACGAGGCGACCGCACAACTCGACTACACCAACGCCCGCCAG
GTTCGACATCTTGCCAAATCCCTTGAGTGCACGTTGGTTGAGATCACCCACCGCCCATCA
GAAGCCCTCGATGCAGACTTCATCATCGTTTTAGAGGATGGCCAATTGACCATGATGGAT
ACACCCAGCAACGTTTCCCAGCACAATGCGTTTTTCCGCACCGCTGTGATGGAGGAAGAA
CAA >RXA02074-downstream
TGATTTCCCGACTTCTCCAATTG
```

Appendix A, page 49

Attorney Docket No.: BGI-125CP

```
>RXA02095-upstream
CTCTCTTGGTCCTCTCCCCACCCATTTTTAAGTACTCAAGACCCTTCCAACAGAAAGGAT
TACTCCCCCAACAGGCTCAAAAATACTGAAAGGCTCACGC >RXA02095
ATGAAAACTGAGCAATCCCAAAAAGCACAATTAGCCCCTAAGAAAGCACCTGAAAAGCCA
CAACGCATCCGCCAACTTATTTCCGTGGCGTGGCAGCGACCTTGGCTCACCTCATTCACC
GTAATCAGCGCTTTAGCTGCAACGTTGTTTGAACTTACACTTCCTCTTTTGACCGGTGGC
GCCATCGATATCGCGCTCGGAAATACCGGAGATACTTTAACCACTGACCTGCTGGACCGG
TTCACTCCGAGTGGATTAAGCGTGTTGACCAGCGTCATTGCCCTTATCGTGCTTCTCGCG
TTGCTTCGCTATGCCAGTCAATTTGGACGGCGATACACCGCAGGCAAGCTCAGCATGGGG
GTACAGCATGATGTCCGGCTTAAAACGATGCGCTCATTGCAGAACCTCGATGGGCCAGGT
CAGGACTCTATTCGCACAGGCCAAGTAGTCAGTCGGTCCATTTCGGATATCAACATGGTG
CAAAGCCTTGTGGCGATGTTGCCGATGTTGATCGGAAATGTGGTCAAGCTTGTGCTCACT
TTGGTGATCATGCTGGCTATTTCCCCGCCGCTGACCATCATCGCTGCAGTGTTGGTGCCT
TTGCTGTTGTGGGCCGTGGCCTATTCGCGAAAAGCGCTTTTTGCGTCCACGTGGTCGGCC
CAGCAAAAGGCTGCGGATCTGACCACTCATGTGGAAGAAACTGTCACGGGTATCCGCGTG
GTCAAGGCATTTGCGCAGGAAGACCGCGAGACCGACAAATTGGATCTCACCGCACGTGAG
TTATTTGCCCAGCGCATGCGCACTGCACGTCTGACGGCAAAGTTCATCCCCATGGTTGAG
CAGCTTCCGCAGCTTGCTTTGGTGGTCAACATTGTTGGCGGTGGCTATTTGGCCATGACT
GGTCACATCACGGTGGGCACGTTTGTGGCGTTTTCTTCCTATCTCACTAGCTTGTCGGCG
GTGGCTAGGTCCCTGTCGGGCATGCTCATGCGCGTGCAGTTGGCGCTGTCTTCTGTGGAG
CGCATCTTTGAAGTCATTGATCTTCAGCCTGAACGCACCGATCCTGCACACCCCCTGTCA
CTTCCCGACACTCCCCTGGGTCTGTCGTTCAACAACGTAGATTTCCGTGGGATTCTCAAC
GGTTTTGAGCTGGGTGTTCAGGCCGGTGAAACCGTTGTGTTGGTGGGCCCTCCAGGTTCA
GGCAAGACCATGGCTGTGCAGCTTGCTGGAAACTTTTATCAACCAGACAGCGGCCACATC
GCCTTTGATAGCAACGGCCATCGCACTCGCTTCGACGACCTCACCCACAGCGATATCCGC
AGGAATCTCATCGCGGTTTTTGATGAGCCGTTCTTGTACTCCTCCTCCATACCGCGAGAA
CATCTCGATGGGTTTGGATGTCAG >RXA02095-downstream
TGATGAGCAGATCGAACACGCAG >RXA02099-upstream
TAGTTAGAGCTGGTTCAAGGGGTGTCAATCCCAAAAGGCACTCCTTGAACTCATGAAAAA
GCTTGACAAAACTTCAACGTCAAAGGAGGTCATCCACGCT >RXA02099
ATGGGTGCAGATCAAATTGCAGCAGTCTCCGGCAATTCAGCTTGGATGCTGATGTCCGCG
TCGCTCGTGCTGCTAATGACACCAGCACTGGCACTTTTCTATGGCGGCATGTCTCGTCAA
AAGTCCGTGCTCAACATGATGATGATGTCCTTTGGAGCATTGGGCGTCGTTACTGTTATT
TACCTCTTGTGGGGATGGTCGATGTCTTATGGAACCCAATCAATCGCGGGAATCTTTGCT
AACCCTTTTGAGTTCTTCGGTCTTAAAGATTCC >RXA02115
ACCCGCGCAACCAAAAGTGTCGGAACAGTTCTCGCACTCCTGTGGTTCGCAATTGTCCTC
GACGGCTTTGACCTAGTCGTCCTGGGTGCAACAATCCCGTCCATGCTGGAGGATCCCGCG
TGGGATCTCACTGCTGGACAGGCCACACAGATTTCCACCATCGGCCTCGTCGGCATGACC
ATTGGCGCACTGACCATCGGTTTCTTAACGGACCGTCTGGGTCGACGCCGTGTCATGCTG
TTCTCTGTGGCAGTATTTTCTGTATTCACTCTCCTGCTGGCATTCACCACCAACGTCCAG
CTCTTCAGCCTGTGGCGTTTCCTCGCAGGTGTTGGCCTTGGTGGAGCACTCCCCACCGCA
ATTGCCATGGTGACCGAGTTCCGCCCCGGCACCAAAGCGGGCTCTGCATCCACCACCTTG
ATGACCGGCTACCACGTCGGCGCAGTAGCAACCGCCTTCCTTGGCCTCTTCCTTATCGAC
GGCTTTGGTTGGCACTCCATGTTCATCGCAGGTGCCGTACCAGGACTGATCCTGCTACCA
CTGCTGTACTTCTTCCTTCCAGAATCCCGCAGTACCTCAAAATCTCCGGCAAGTTGGAT
GAGGCGCAGGCAGTTGCAGCATCTTATGGACTTTCCCTGGATGATGATCTTGATCGCGAA
CACGAAGAAGAACTCGGCGAGTCCTCCTCACTTTCCTCCCTGTTCAAGCCCTCGTTCCGC
CGCAACACCCTGGCGATTTGGGGCACCTCATTCATGGGACTCCTCCTGGTCTACGGCCTG
AACACATGGCTGCCACAAATCATGCGCCAAGCAGACTACGACATGGGTAACTCGCTTGGA
TTCCTCATGGTGCTCAACATCGGCGCAGTGATCGGCCTTTATATTGCAGGGCGAATTGCC
GATAAGAACTCCCCTCGCAAAACAGCACTCGTATGGTTCGTGTTCTCTGCATTTTCCCTC
```

Appendix A, page 50

```
GCGTTGCTTGCTGTCCGGATGCCACTGATCGGTCTGTATGGCATCGTGCTGCTCACCGGC
ATCTTTGTGTTCAGCTCCCAGGTACTCATCTACGCCTTCGTTGGTGAGAATCACCCTGCC
AAGATGCGCGCAACCGCCATGGGATTCTCCGCAGGAATTGGTCGCCTCGGCGCCATCTCT
GGCCCGTTGCTTGGTGGTCTGCTTGTCAGTGCCAACCTTGCTTACCCATGGGGCTTC

>RXA02128-upstream
TATTAGCAAAACTTCTTAAAGAGCCTTTTTGTGCCTTTATCCGAGTATCTTTAAAAGCAT
GAGTATTAAGTGGGCGCGCTTTGTACCGGGGATAACCGCG >RXA02128
ATGCGGGGCTATCAACGATCCTGGTTGAAGGGTGATGTCATCGCGGGTATAACCGTGGCC
GCGTACTTGGTTCCACAAGTCATGGCTTATGCCGTCATTGCGGGGCTGCCAGCTGTCGTT
GGTCTGTGGGGAGTTCTGGCTCCCATGGCGCTGTACTTTTCTTGGGCACGTCTCGAAAT
CTCTCGGTTGGTCCTGAATCAACCACCGCTCTGATGACGGCTGCAGGTGTGGGAGCTTTA
GTCGGGGCAGCTGGCGGGCCTGAACGATACGCAGAAGTAGCGGCACTATTGGCTATTGCA
GTGGGCATTGTATGCGCTGTTGGTTTTATTGGCCGATTGGGATTTCTTACCAGGCTGTTG
TCTCGACCGGTGCTCGTTGGATATTTGATCGGTATTGCAGTCTTGATGATCGTCAGTCAG
CTGTCCAAAGTCACCCAGGTGAATGTGGAGAGCGGTCAGACGTGGCAGGAAATAATATCG
TTTATCAAAGTAGCTGGCCAGGCACATATTCCTACAGTGATTTTGGCAGTCGTGGTGTTG
AGCTTGCTGTATCTGGCAAATTGGTTGACGCCTAAATTTCCCAGCACACTCATGGTTCTT
CTGCTTTCGGCAGCCGCGGTGGGGTTTTTCATCTGGATAGGTTTGGTCTTGAGGTCATT
GGTGAGGTGCCCCGTGGCCTGCCTCAACCAAGTATTCCCTCGATTGGCGATCTAGAGATC
TGGTCGTTGTTGCCCTATGCCGTGGGTATTGCCATCGTTGGTTTTTCAGACAATGTGTTG
ACTGCTCGTGCATTCGCGTCGGGAAAAGATGAGGTGATTGATTCCAACCAGGAGCTGCTC
GCACTGGGAACCGCAAACCTGGCGAATGGGTTCTTCCAGGGATTTCCTGTGTCATCGAGT
GGCTCCCGAACTGTTCTTGGAGACACGGCAGGTGCTCGCACTCAGGTGCATTCACTTGTC
GTGGTGGCGCTGGTGATCATGGTGCTGTTGTTTGCTGGTCCTGTGCTCGAGTCTTTCCCA
GATGCGGCACTTGGCGCCTTAGTTATTTATGCAGCAACGCAGTTGATTGATATCGCAGAG
ATCAAAAGGATCGCACGTTTCCGCAAGAGCGAGTTGGTCATCACAGCGGCTACTGCTGCA
TCCGTTGTGGCTTCTGGCGTGCTCGCGGGGATCGGCGTTGCGGTTACGTTGTCCATCTTG
GATCTCATCAGACGTATTACCCGACCTTATGCCGATGTCCTAGGATATACGCCGGGCATG
GCTGGAATGCACAGCTTGGAGGATTATCCTGAGTCGACAGCAGTCGAAGGGCTCGTGGTT
TTTAGATACGATTCCCCACTGTTTTTCGCCAACGCTGATGATTTTTCCAAACGTGCCATC
GAAGCCGTTGATGAAGCAACTCAACCCGTGCATTGGTTTTTACTGAATGCTGAAGCGAAT
ACGAAGTTGATCTCACGGCCGTCGATGCCATGGAAGCACTTCGCAAAACCCTGGAGGAA
CGGGGTATCCGATTTGCGATGGCCCGGGTGAAGCAAGATCTACGCCGAAGCCTCGAGCCT
GCAGGTTTCATTGAATCCGTGGGGGAGGAGTACATTTTCGCCACACTCCCCACTGCAGTC
AAGGGGTATTCCGTGGAGTTTCGCGATCGTTTTGGAAACTATCCAGAAGGCGTTCCGAAA
GAAATTTTGGAACTT >RXA02128-downstream
TAAGCTGCCTGGTTGGCGGACTT >RXA02133
GAAAACCCCTACATTGGCGGAGCTGGATACAACGCAGCAAAATTCGGTGTAGCAGCATTC
AACCGTGTGCTTCGCTTGGAAACCCACCAGCAGACCCTTCGCGTATCTGAGATCGATCCA
GGTCGAGTTGCCACGGAAGAATTCTCCCTCGTTCGTTTCGGCGGAGATAAAGAACGCGCA
GAAGCAGTCTATGACGACGTCCTCAACCTCACCGCTGAAGACATCGCAGAGTCTGTGCGT
TGGGTCGCGAGCCTTCCAAAGCACATGAACATTGACCGCATGCGTATTACACCTCGCGAT
CAGGTC >RXA02133-downstream
TAAAACCCGCACTCTTTTGAAAT >RXA02150-upstream
GTGTTTTTCGGTGGGCTGCGATGACGCATGTCCACCAAAAGAGCCACCCCTTAAAGAAAT
TAAAAAGTGGTTTTGGTAGCTTCGCAGCAAAATACACATC >RXA02150
GTGGGTAACGTATTCTTAGAAGTTCCTACAGCAGTAAAGCGCGAAGAAGGGGTAAACCCA
AACATCATGAAAAACAACTGGTATCGGCTTTTCAAGTATGTGCTAATTGGCCCGTTTTTG
```

Appendix A, page 51

CGTGTGTACAACCGCCCGGAGATCGAAGGCAAAGAAAACATCCCTGCAGAAGGTGCCGCG
ATCATGGCGTCCAACCACGAAGCAGTGATGGATTCCTTTTATTTTCCCCTGCTGTGCCCA
CGGCAGCTGACCTTCCCAGCGAAGGCCGAATACTTCACATCACCAGGTATTAAAGGCAAG
ATGCAGAAGTGGTTTTTTACTTCTGTGGGGCAAGTACCCCTGGACCGCACCGCAGATAAT
GCCATGGATTCTTTGATGAATACCGCCAAAATGGTGCTGGATCGGGGAGACCTCTTCGGT
ATTTACCCTGAAGGATCTCGTTCGCCCGATGGTCGCATCTACAAGGGCAAAACCGGAATG
GCCTATGTTGCGATGGAAACTGGTACGACAGTTATCCCCGTTGCCATGATTGGCAGCCGG
GACGCGAACCCTATCGGAAGTTGGTTCCGAAACCCGCAAAAGTCAGGATCAAGGTAGGA
AGCCCAATTGATCCCCTCGCATTCGTCAAAGAACATGGGTTGAAGCCTGGAACCTACGAA
GCAGCGCGCAAGCTGACAGATCACGTTATGTTCATTCTTGCTGATCTCACTGGTCAGCCG
TATGTTGATGCGTACTCTAAAGATGTGAAAAACGCTCTGGAGGAAGGAAAAGGATACCCG
GAGGGCACAGCTCCTTCACAG

>RXA02150-downstream
TAATCGGGTCTTTTCTGTTAAAA

>RXA02171-upstream
AACCACATTCGTCATTACTTACATCTATGTCATGTTTGCGAACAAGAACTTGGAGCCTCG
TCAGGCTGCTATTCGCCAGAAGATGGAAGGTTAATCAGAT >RXA02171
ATGAATTCCACTATTCTCCTTGCACAAGACGCTGTTTCTGAGGGCGTCGGTAATCCGATT
CTTAACATCAGTGTCTTCGTCGTCTTCATTATTGTGACGATGACCGTGGTGCTTCGCGTG
GGCAAGAGCACCAGCGAATCCACCGACTTCTACACCGGTGGTGCTTCCTTCTCCGGAACC
CAGAACGGTCTGGCTATCGCAGGTGACTACCTGTCTGCAGCGTCCTTCCTCGGAATCGTT
GGTGCAATTTCACTCAACGGTTACGACGGATTCCTTTACTCCATCGGCTTCTTCGTCGCA
TGGCTTGTTGCACTGCTGCTCGTGGCAGAGCCACTTCGTAACGTGGGCCGCTTCACCATG
GCTGACGTGCTGTCCTTCCGACTGCGTCAGAAACCAGTCCGCGTCGCTGCGGCCTGCGGT
ACCCTCGCGGTTACCCTCTTTTACTTGATCGCTCAGATGGCTGGTGCAGGTTCGCTTGTG
TCCGTTCTGCTGGACATCCACGAGTTCAAGTGGCAGGCAGTTGTTGTCGGTATCGTTGGC
ATTGTCATGATCGCCTACGTTCTTCTTGGCGGTATGAAGGGCACCACATACGTTCAGATG
ATTAAGGCAGTTCTGCTGGTCGGTGGCGTTGCCATTATGACCGTTCTGACCTTCGTCAAG
GTGTCTGGTGGCCTGACCACCCTTTAAATGACGCTGTTGAGAAGCACGCCGCTTCAGAT
TACGCTGCCACCAAGGGGTACGATCCAACCCAGATCCTGGAGCCTGGTCTGCAGTACGGT
GCAACTCTGACCACTCAGCTGGACTTCATTTCCTTGGCTCTCGCTCTGTGTCTTGGAACC
GCTGGTCTGCCACACGTTCTGATGCGCTTCTACACCGTTCCTACCGCCAAGGAAGCACGT
AAGTCTGTGACCTGGGCTATCGTCCTCATTGGTGCGTTCTACCTGATGACCCTGGTCCTT
GGTTACGGCGCTGCGGCACTGGTCGGTCCAGACCGCGTCATTGCCGCACCAGGTGCTGCT
AATGCTGCTGCTCCTCTGCTGGCCTTCGAGCTTGGTGGTTCCATCTTCATGGCGCTGATT
TCCGCAGTTGCGTTCGCTACCGTTCTCGCCGTGGTCGCAGGTCTTGCAATTACCGCATCC
GCTGCTGTTGGTCACGACATCTACAACGCTGTTATCCGCAACGGTCAGTCCACCGAAGCG
GAGCAGGTCCGAGTATCCCGCATCACCGTTGTCGTCATTGGCCTGATTTCCATTGTCCTG
GGAATTCTTGCAATGACCCAGAACGTTGCGTTCCTCGTGGCCCTGGCCTTCGCAGTTGCA
GCATCCGCTAACCTGCCAACCATCCTGTACTCCCTGTACTGGAAGAAGTTCAACACCACC
GGCGCTGTGGCCGCTATCTACACCGGTCTCATCTCCGCGCTGCTGCTGATCTTCCTGTCC
CCAGCAGTCTCCGGTAATGACAGCGCAATGGTTCCAGGTGCAGACTGGGCAATCTTCCCA
CTGAAGAACCCAGGCCTCGTCTCCATCCCACTGGCATTCATCGCTGGTTGGATCGGCACT
TTGGTTGGCAAGCCAGACAACATGGATGATCTTGCTGCCGAAATGGAAGTTCGTTCCCTC
ACCGGTGTCGGTGTTGAAAAGGCTGTTGATCAC >RXA02171-downstream
TAAATCTAGTTTCTGAAGTTATT >RXA02173-upstream
CTAAATTGGGCTTAGATCTTCCGCCTCTAAATAGGTATGCAGAGACATTCGAATTAATTA
ACAAAGCCATTTTTCGGCCGTGGAGAAGCGTTTTCCGACT >RXA02173
ATGGTGTGGGCATGGAACACACTTCAGCATTGACGCTCATAGACTCGGTTTTGGACCCT
GACAGCTTCATTTCTTGGAATGAAACTCCCCAATATGACAACCTCAATCAAGGCTATGCA
GAGACCTTGGAGCGGGCTCGAAGCAAGGCCAAATGCGATGAATCGGTAATTACTGGAGAA Attorney Docket No.: BGI-125CP

```
GGCACCGTGGAGGGCATTCCGGTAGCCGTTATTTTGTCCGATTTTTCCTTCCTCGGCGGT
TCTTTGGGCACGGTCGCGTCGGTGCGCATCATGAAGGCGATTCACCGCGCCACAGAGCTG
AAACTCCCACTGCTGGTCTCCCCTGCTTCCGGTGGTGCGCGCATGCAGGAAGACAATCGA
GCTTTTGTCATGATGGTGTCCATAACCGCGGCTGTGCAGCGTCACCGCGAGGCGCATTTG
CCGTTCCTGGTGTATTTGCGCAATCCCACGATGGGTGGCGCCATGGCCTCGTGGGGTTCA
TCTGGGCATCTCACTTTTGCGGAACCCGGCGCGCAGATAGGTTTCCTGGGTCCTCGCGTG
GTGGAGTTAACCACTGGGCATGCGCTTCCAGACGGTGTGCAGCAGGCGGAGAATTTGGTG
AAAACTGGTGTGATTGATGGAATTGTGTCGCCACTCCAATTGCGTGCAGCGGTGGCAAAA
ACCCTCAAGGTTATTCAGCCGGTAGAGGCAACGGATCGTTTTTCTCCAACAACTCCTGGC
GTGGCACTTCCGGTGATGGAGGCGATTGCGCGTTCTCGTGACCCGCAGAGGCCTGGAATC
GGGGAGATTATGGAAACGTTGGGGGCAGACGTCGTCAAGCTTTCTGGTGCGCGTGCTGGC
GCATTGAGCCCGGCTGTGCGCGTTGCCCTGGCGCCATCGGGGCCGGCCCGTGGTGCTG
ATTGGGCAGGATCGCCGCTTCACGCTTGGGCCGCAGGAGCTGCGTTTTGCGCGTCGTGGC
ATTTCGCTGGCGCGCGAGCTAAACCTGCCGATCGTGTCCATCATCGACACCTCCGGCGCC
GAATTGTCGCAGGCGGCTGAGGAGCTCGGCATCGCAAGCTCGATTGCGCGCACCTTGTCC
AAGCTTATCGACGCTCCCCTCCCCACCGTTTCGGTCATTATTGGTCAGGGCGTTGGCGGT
GGCGCGCTGGCCATGCTGCCCGCCGATCTGGTCTACGCGGCCGAAAACGCGTGGCTGTCC
GCATTGCCACCAGAGGGCGCCTCGGCCATCCTCTTCCGCGACACCAACCACGCCGCGGAA
ATCATAGAGCGACAAGGCGTGCAGGCGCACGCACTTTTAAGCCAAGGGCTTATCGACGGG
ATCGTCGCCCGAAACCGAGCACTTTGTTGAAGAAATTCTCGGCACAATCAGCAACGCCCTC
TCCGAATTGGATAACAATCCGGAGAGGGCGGGACGCGACAGTCGCTTCACACGATTTGAG
CGTTTAGCGCAG

>RXA02173-downstream
TAAAGAAAATTATGCGCTGATCA

>RXA02224-upstream
GCTTCGTCGAGGCCGGAAAACCGTCGTCATTACGTCGAACCCGACGTGGCACGGCGTCGC
AAAGCAGATGCAATCTGATTTTTCGGAAGGGGTGAAGTAG >RXA02224
ATGGCGCAGCATGAGCGCGTTGCGGATGCGCTGCAGCCGGCGTCGTTGGCGGAGTCGTGG
CGTGAGCTGAAAACGATGCCTTCGGGGCCCAAGGCCTGGTGGTATGTGAGTTTCGTGGTT
ATTAGCGTGGTCACGGTCGTGGCGATGGTCGGCACGTCCAACTTGTTGGGCTATTCCGTT
GATCTGATCAATGGGCAGTCGTTGCCGCTGATCGGTTCAGGATCGACCGCAATGATCTGG
TTGCTTGGTTTGGTGGGCGCTGGAATTTTAGCAGAAACTGCCGGTCGCGCGCTGCTGCAA
TTGGTGATCAACACCTTGGCACGTCGCCTGTCGGTGGATCTGCGGAAAGCTGCGCTGTCT
TCGGCGTTGCGTGCACCGGTTCCTGATGTCATGGAATTGGGCACGGGAAACGTGATTAGC
CGCCTGACGCAAGACATCGATAACACTGTGCGCATCGTCGGCATGGTAGGTGTGCGTTTG
GTGATCACCATTTTGATTCTGCCCAGCTCCTTGTTCGCGTTGATGACCATTCACTGGACC
TTTGTGATCCTGTTCATCGCAGTGATTGTGGTGCTGATTCCCAGCGGTCGGAAAGCCGTG
CGAGCTATTCCTTCGGCAACAAATATTGTGTCCAGTACGGAGGCGCGTCGAAACAATCTG
CTCCTCGATACGATCCGTGGCATTGAAACACTGCGTGTGCTCAAGCTCGGTGCGTGGGGT
GTGCAGCGGATGCGCCAAGCGTCGTGGACTGCGGTGCAAGCAACAGCTGATCGCGCGCCG
ATTTTCACTCGTCTGCTCGCCCTTGGTTCGATTGCTTATGGCCTGCTGCTAATTGGCGTG
TTTGGGCTCAGTGCGTTTTGGGTTGCCCAGGATGCGATGAGCATTGGAGCGGCAACGGCA
GCAGTTTTCGTGGTTGTGCGCATGGAAATTCACGTGTTCAACGTGCTGCTTCTTCGCATCG
GAAATTCAGAGTGCGTCTACTTCTCTTGGTCGCGCGGTGTCCCTTGCCCAGATGGCTCGT
CGCACCGAACAGCTGTCTGAGTCTGCCGATTGCACAGAACCACCCTCCGTGACTGTGCAG
GACGTGACGTTTAAATATCCCGGCGGCGTGGCCATTTTGGAGGATTTCAATCTGGTCTTG
GAAGCAGGAACAACCACAGCGCTGGTCGGTACTTCTGGTGCGGGAAAATCCACGCTCGCG
GGCGTCATTGCGGGGCTGCAGCGCCCTGATTCCGGCGCCGTTTTGGTCGGGGGCATCAAC
ACCGCCACCGTCACCGACACGTGGACTACCCGCCAGGTTGCGCTGATCAGCCAGGAAGTC
CACCTTTTCGCAGGCACTCTGGCAGAGGATCTTCGCATGGCCAATGCGCACGCCACCGAC
GCGCAGCTCCACGCAGCGCTCGAGTCGGTCGGGCTCGGGCAAATGACAACTGCTTTTCGA
CGTTTCTTTCCATCCGGATTAGACACCAAAATTGGCGCCGGCGCAGAAGAACTCACCCCT
GAAATCCAACAGCAAATCTCTCTTGCCCGCATCGTGCTCCGCAATCCACCTGTGTTGATC
ATGGATGAAGCCACCAGTGAAGCCGGCAGCGATGATGCCCGCATGTTGGAAAAAGCCGCC
ACAGAAATCGCACGAAACCGCACCACCTTGGTTGTTGCGCACCGCCTTGACCAAGCAGTT
GTCGCAGATCGCATCATCGTGATGGAACAAGGCACAATCACCGAAGACGGCACTCACCAG
GAATTACTTGCTTTTGAGGGCCGCTACGCGCAGCTGTATCAACGATGGAGTGCTCAA
```

>RXA02224-downstream
TAGTTCAAATCCACCACAAACTC

>RXA02225
CAAACTGAGGAGCGCTTTGGCGCAGCGGCTGATGAAGCCTTGGCAATCATGTTGAAGGAA
GCTCGTCTGCAGTCGTTGCTGACTTTTGTGCGCCAACTTGTCCCAGCGGTGTTTTCTGTG
GGTCTTTTGGCTTATGCGTCACTGTTGGCTTTTGACGGTGACATAACTGGTGGTGAGATG
ATCTCGGTGACGTTGCTGGTGCCACCTTCGTTGACTGTGTTGGGTGTGTCGCTTGGCATG
ATGACAGAGATTTGGGCTAGGGGACAGGCTTCGACAAAAAGGGTCCAAAACTTAGTCACT
GAACTGGATAAGGCGGCCGCTGAGCCACGACCTCAGCCTGCCACCTTTGAATTTGAAGAG
GGGATCACGGTGTGGGATCCTTCGACACCTGAGGCACGCGATGTGATTGATCGGGAGTTG
GAGGCGCTTCAGGTTCGCGAAGATGTCATTGTGGCTCCTCACCGCGTCAGCGTGTTTGAA
GGTGTGCTGAAGGATAATTTGAATCCGATGGGCACTATCGCACCGGAGATGCTGCGCGCT
GCTCTTCATGCTGCAAGTTGTGAGGACATCTTGAGCCGATTGGGTGCTGATCTGAACATG
CCGGGGGAGTTTGAGCTTCCAGATACCTTGATCGGCGAGGCCGGATTGAATCTCTCCGGT
GGCCAACGCCAGAGGATTGCTTTGGCACGATTCTTGGCTGTTGATCCTGAGGTGCTCATT
TTGGATGAACCGACCACGGGGTTGGATGCGGTGACCCTGGATGAAGTGGCACATCGCGTC
GAAAAGCTTCGTCGAGGCCGGAAAACCGTCGTCATTACGTCGAACCCGACGTGGCACGGC
GTCGCAAAGCAGATGCAATCTGATTTTTCGGAAGGGGTGAAG

>RXA02225-downstream
TAGATGGCGCAGCATGAGCGCGT

>RXA02233-upstream
ATCCCCACCCAATTGGCCCAAGAGCTGCAGAGTTACGTTGTAGAACCCACCTCTGCCTAA
CTGTCGATTTCCCAAGAGCCCCCTTGGGAGTCGATAATTA >RXA02233
GTGCTCGTGACTTCAACATGGGGATGGACCGTCCACGGAGACGGCAAAAAGATCGAACCC
GGCGCAGTTGTCGCTCCTAAAGAGCGCCTGAGCTGGGGGCGCACAATTGGAATCGGTATG
CAGCACGTGATCGCCATGTTCGGCGCCACGCTCCTGGTTCCCACACTCACCGGATTTCCG
GTCAACACCACACTTTTATTCTCTGGTCTGGGAACAATCCTGTTCCTGTTGATCACCAGA
AACCGACTACCCTCGTACCTGGGTAGTTCTTTTGCTTTCATTGCACCTTTAACCGCAACC
CAAGTCCATGGCATTGGCGTGCAGATCGGTGGCATTCTTGTCGCAGGTCTCGTGCTCGTC
GCCATTGGATTTGTGGTGAAAGCAGCGGGCAAACGCGTTATTGATGCTGTCATGCCACCC
GCTGTCACCGGTGCGATCGTGGCACTCATCGGCCTGAACCTGGCACCAACCGCGGCAGGA
AACTTCTCCAGCCAACCACTGGTTGCCACGGCGACCCTCTTTGCCATTTTGATCGCTACC
GTTGCAGGCCGCGGAATGATTGCTCGCCTGGGCATTTTGATCGGTGTGGTGATCGGCTGG
GTTTTCGCAGCTATCACCGGCAACCTCTCAGAAGGCGCAGCAGACACCATCCGTGAAGCA
GCATGGTTCGGACTGCCACAGTTCCACAAGCCGGAATTCCAGCTCTCTGCCATTTTGGTG
ACACTGCCAGTCATCATCGTGCTCATCGCTGAAAACGTCGGCCACGTCAAAGCAGTCTCA
GAGATGACAGGGGAGGACCTCGACGACCTCGCCGGCGACGCACTTATCGCAGACGGATTC
GGCACCACCCTCGCAGGTGCCTTCGGTGGATCCGGCACCACCACCTACGCAGAAAAACATC
GGCGTCATGGCGGCCACCCGCGTATATTCCACCGCTGCGTACTGGGTTGCCGCGTGCACT
GCCATCGCCCTTGCCTTCATCCCCAAATTCGGTGCACTGATCTTCACCATCCCCGCCGGC
GTGCTGGGTGGGGCATGTTTGGTTCTTTACGGCCTAATCGGTATGCTCGGCATTCGTATC
TGGCAAGACAACAAGGTCAACTTCAACAATCCAGTGAATCTGACCATGGCTGCCGTTGCT
TTGGTTGCAGGCATTGGTAACCTCACCCTCACCGTTTTCGGAGTCACTCTTGAAGGCATC
GCATGGGCTCTG >RXA02233-downstream
TAGGCATCATTGTGCTGTACCCA >RXA02253-upstream
TGAGGACATTTCCCAAGTGAAAGGCTTCGGCCCGAAACTTGCGGAGGCTGTCTATGAAGG
TCTTCACGCGTCAAAATAAGTAGATCGCTAGGATGTAACC >RXA02253
ATGATTCAATCCACTGGGGTCACGCACACTGATAAGTCTGCACAAGAAAATCCTGTGAAG
TACAGGGACAATTTCACACCTGTCATCATCACCGGTATGTCAGGCGCAGGTCTGAGCACA Appendix A, page 54

```
GCAGCCCGAGTCCTCGAAGACTTGGGTTGGTATGTGGCGCACAATATTCCACCACAGATC
ATCCTGGAATTAATTGATATGTGCGCTCGGGAAGATTCTCCCGTCGACAAAGTTGCAGTC
GTGTGCGATGTGCGCTCCCGTGAATTCCGCGGAAGCCTCACCCAGGTTGTTTCAGAGCTG
CGTGATAAGCAGCTCGATCCCACGGTGTTATTTCTGGAAGCACGCGATGAGGTGCTGATC
AAGCGATTCGATAATGTGCGCCGCACCCATCCTTTGCAGGGCAGCCAAACCCTTCAGGTG
GGTATTGAACGTGAACGAACCGTGCTGTCTCCTGTGAAGGAAGACGCTTCAGTGGTCATC
GATACCTCGGATCTGTCCGTGCATGATTTGCGCCGCGCCATCGAATCTCGTTTAGGACA
ATCGCCACGCGCACCCAGCACGTCACCATTGAATCATTCGGTTTCAAACACGGCTCACCA
CGCGACGCCGACTTTGTTGTGGACGTGCGTTTCTTGCCGAACCCATTCTGGGTTCCAGAG
CTGCGCCCATTAGGGGAGTGGACAAGCCAGTATCTGACTATGTGCTCTCCCAAAAAGGC
GCAGAAGAATTTTTGAACAACTTTGTGGACATGCTCAAAGACATGCTTCCGGGATACCGC
CACGAAGGAAAAAACTTCATCACAATCGGTGTCGGCTGCACCGGTGGACACCACAGATCA
GTTGCGGTGTCTGAAGAACTAGCCAAAAGAATCGCAGATCAGACCACGCTCGACGTGTCT
GTAGTACACCGCGATATTAACCGCCAC

>RXA02253-downstream
TAGGAAAGGGGCCAACTAATTGA

>RXA02261-upstream
GAAATCTATAGAACGATAGGTAAAAACTGGACTAGGTTTATCTATAGCGGAATAGAAAAT
ACTCCGCTCGACAGCATCACTTAGCTGAAAGGCCTTTAAC >RXA02261
ATGGACCCCTCAGATCTAGCCTGGATTCTCGCAGCTTTTGCGTTGGTAAGCCTGATGTTC
CCCGGATTGTCCCTGCTCTACGGCGGCATGCTGGGTGGGCAACACGTTCTTAACACGTTC
ATGATGGTTATGAGCTCACTTGGAATCATCAGCCTTGTGTACATCATTTATGGACACGGA
CTTGTCTTAGGAAACTCCATCGGTGGGTGGGAATTATCGGAAATCCCCTTGAATACTTC
GGCTTCCGCAACATTATGGAAGATGACGGCACCGGAGACCTCATGTGGGCCGGCTTCTAC
ATTCTGTTCGCTGCAATCTCACTCGCACTTGTTTCATCTGGTGCAGCGGGGCGCATGCGC
TTTGGAGCGTGGCTGGTCTTCGGTGTCCTGTGGTTCACCTTTGTGTACGCGCCACTGGCA
CACTGGGTTTTCGCTATCGATGATCCTGAGTCCGGCTACGTGGGTGGCTGGATGAAAAAT
GTGCTTGAGTTCCACGACTTTGCTGGTGGAACGGCAGTGCACATGAATGCGGGTGCGTCT
GGACTCGCGCTGGCAATAGTGCTGGGACGCCGCCACTCCATGGCTGTGCGTCCACACAAC
CTTCCACTGATTTTGATTGGTGCAGGACTGATCGTTGCGGGCTGGTTCGGATTCAATGGT
GGTACCGCAGGTGGTGCCAACTTCCTCGCAAGCTACGTGGTCGTTACCTCTCTCATTGCT
GCAGCTGGCGGAATGATGGGCTTCATGCTCGTTGAACGTGTGTTCAGCGGAAAACCCACT
TTCTTTGGCTCGGCAACCGGCACAATCGCAGGCCTTGTGGCTATCACCCCGGCCGCGGAT
GCAGTGAGCCCGCTCGGAGCATTCGCCGTCGGAGCGCTCGGCGCAGTTGTCTCCTTCTGG
GCAATTAGCTGGAAGAAGGGACACCGAGTCGATGATTCCTTCGATGTGTTCGCAGTCCAC
GGAATGGCCGGCATTGCAGGTGCACTGTTTGTCATGCTCTTTGGCGATCCACTAGCACCA
GCGGGAGTTTCCGGAGTCTTCTTCGGTGGCGAACTCTCCCTGCTGTGGAGGGAACCACTG
GCCATCATCGTGACCCTTACATACGCATTCGGCGTGACCTGGTTGATTGCCACGATCTTG
AACAAGTTCATGACTCTGCGCATCACCTCCGAAGCCGAATATGAAGGCATTGACCGCGCA
GAACACGCAGAATCTGCCTACCACCTCAATTCCAACGGAATTGGGATGGCAACCCGCACC
AATTTCGGACCTGAAATCCCCGAGGAAACCGTGCCCGACGCCGTGCAGGTGGGCGTCGAT
AAGCAAAAAATCGCTGATACTCGAAAGGCCTCAAAA >RXA02261-downstream
TGACCGCAACCTACACCACTGAA >RXA02268-upstream
TGAATCGTTGGTGCTTCGAGTTGGGATTGTTATGTGGGGAGACGTCGATAAGCAAAACAC
TTGCCGAGCGCAAGCCGGCCTACGGCGCTAGTGTGAGCAC >RXA02268
ATGTCCCAGGAAAATTCTGGTTTGTTCAAGCGCGCGATTACACGTGGGGTGGCTAAGGTG
CGCCGGAATCCGCGCGAGGATTTTGCGGAGGAATTCACCCAAGAACTCTACGATCACGCA
ACAAATATCACCCTGCCCCTGACGGCGCGGCTGAAGCCGAATGGGTTTTTCCAGGATGAT
TGGCGGGCGCGACCAAGTGGTGCGCGACCGTGGCCGATCGTGCTAATTCACGGATCCGGG
GCCAGCAAGGGTTCATGGGAGGAAATCGGCGCTGAGCTGCGCAGCAAAGGTTGGGCCGTG
TTTGCCCCTGACTTTGGAACGCGTGCCACCGAGCCAATTGCGGCGTCGGCTGCCCAAATT
```

Att / Docket No.: BGI-125CP

```
GGTGCGTATATTGATGCCGTTTTGTTGGTGACGGGCGCTGCGCAGATTGTGCTGGTTGGG
CATTCGCAAGGCGGTGTCGTGGCGCGGTATTGGATGCGCACCTACGGCGGATACATGAAG
GTCAGGCACATGATTTCCATCTCTACGCCAAATCACGGAACGCTCATGGGAGGCATTTTA
AACCCGATGACGAAGGTGAAATCGGGAGAGGGAACGATCGAAAAGCTGATGCACAGACTA
TTCGGGCCCACTGGTTTTGAACAGCTGCGCGGACACGACATCATCGAGTTTTTGGCCGAC
GGTGGGGACCTCGATCCAGGCGTCACCTACACCTGCATTGGTACCCATTTTGATCCTTTC
ATCCAACCTCCGGAGGTGGCCTTTTTGGAGGTCAACGAGGACGATGATCCAAATCGAGTC
CACAATATTTGGGTCGAAGATGAACACCCGCGCGCAATGATTGCCCACAACGATATGGTG
CGCGATCCCAGGGTGATCGAAATCGTACGCGCAGAGCTCGACCGGGTGGCACGCCTCGGC

>RXA02268-downstream
TAAGTTGGGGACATGGTTGACGC

>RXA02269-upstream
CGCAATGATTGCCCACAACGATATGGTGCGCGATCCCAGGGTGATCGAAATCGTACGCGC
AGAGCTCGACCGGGTGGCACGCCTCGGCTAAGTTGGGGAC >RXA02269
ATGGTTGACGCCCTCAATGATCTCCGCCGAGAACTCACAAACGCGTTAAGGTCCGTGTGG
AAAAACCTCCCCACTGATAACGCCCCGCAGGCCGATGCCTTGCCAGACGATGTAGTGGAA
GAGATTGCGATAAATTTCTACCGTGATCCCAAAAACGCGGCAAACTCAACGAAGACAAA
ACAGATTCCTTGCCGATGCTCGCGCGCATACGTTCACGTGGACTTTTTGAAGACGATTGG
CGCGCCCGCCCCACCGAAGACCGCCCCTGGCCAGTGGTATTAGTCCACGGAACTGGATCA
ACAAAAGGTGATTGGCAAGACTTGGGAGCCGATCTACGCCGCGACGGCTGGGCAGTGTTT
GCACCCGAATTTGGCCAACGCGCCACCGGTTCAGTCGCAGAATCATCCGCACAAATTGGC
GCCTATATAGATACAGTATTGCTTGCTACAGGAGCCTCAAAAGTCATTGTCGTTGGCCAC
TCCCAAGGCGGCGTGTTGCTGAGATACTGGATGCGTGTTTTGGGTGGTGCATCCAAAGTC
AAACACATGGTCTCCCTCGCTGTCCCCAATCACGGCACCACCATGGGCGGAATCGTCAGC
CCGCTAATCCGTAACAATCGTGGCGAAAGTGTGGTTAATTCTGTCGTTCAATCATGGTTC
GGCGAAGCTGGATTTGAAATGATCCGCGGACACGACACCATCAACGCCATCAATGAAGGC
GGCGATTTGGATCCAGACGTGACATATCTGTGCATCGCCACCCACTTTGACACCGTGATT
CAGCCCCCTGAAACCTGCTTCCTAGAGGCCCGGAACCCCGAAGAACTCAAGCGGGTCCAA
AACATCGGGTGGAAAACCTCGACCCCAATTCAGTCGTGCTCCACGAAGCAATGCCTTAC
GATCCCCGCGTACGCGCACTGGTCAGGGCGGATTTGAGCAAATTGGTGGAGATTTCCGAG
ACTGCGGAGAAC >RXA02269-downstream
TAGGGGTTTTGGTGGTTGTCTAA >RXA02309-upstream
GTGCCTTCCGTCGACTACGGTTAAACAAAAAGCTTTTTGTCCATTTCACTGGATTCACCG
AAAGAATGAATCCACACTCGATCACCAAAGGTAGCGATGA >RXA02309
ATGAGTAGCGGCCGAACCGTTCCAACCCGTTCCCACGGGCTCGGAAAAGAAGGTGTATCC
ACCACAGGAGCATCTCAGGTCGAGTTTGGTGATCCCGAGCTAACGGCCAGGATCAATGAC
GCCATGGTGCAGGTAGAAGAACTCCTGCACACTGAACTATCGTCCGGGGAAGACTTCCTC
GTCGATATCGTCATGCACCTAACACGAGCCGGCGGCAAACGATTCCGCCCCATGTTTGCA
CTGCTGGCCTCCGAGTTCGGTGAAAAACCACTCTCCGAAAACGTCATCAAAGCCGCCGTT
GTCGTAGAGATCACCCACCTGGCCACCCTGTACCACGACGATGTCATGGACGAGGCATCC
ATGCGCCGCGGCGTCCCAAGTGCTAACGCGCGATGGGACAACTCCGTAGCCATCCTCGCA
GGCGACATCCTCCTAGCACATGCATCAGGTCTGATGAGTCAGCTGGGTACCGACACAGTC
GCCCACTTTGCCGAAACATTCGGCGAACTAGTCACCGGCCAAATGCGCGAAACAGTCGGG
CCACGCGACACCGACCCGATCGAGCACTACACCAACGTAATCCGTGAAAAAACTGGTGTC
CTCATCGCCTCCGCAGGCTATTTGGGAGCCATGCACGCAGGCGCCGCACCTGAACACATC
GACGCCCTGAAGAACTTCGGCGCAGCCGTCGGCATGATCTTCCAAATCGTCGACGACATC
ATCGACATCTTCTCGGAAACCCACGAATCCGGAAAAACGCCCGGCACCGACCTCCGCGAA
GGTGTATTCACCCTCCCAGTGCTCTACGCACTCCGTGAAGACACCCCCGTCGGCGCAGAA
CTCCGCGACATCCTCACCGGCCCTCTAGAAGACGACGAGACCGTCAACCACGTCCTCGAG
CTCCTCTCCCAATCCGGCGGACGCCAAGCAGCCCTCGACGAGGTCTACCGCTACATGGAC
ATCGCCAACGCAGAA
```

Attorney Docket No.: BGI-125CP

>RXA02310-upstream
GAAATGGACAAAAAGCTTTTTGTTTAACCGTAGTCGACGGAAGGCACTTGAAGCACCTTG
GGTTAGTCTTCTTGCTCTCCGGACTGAGACAATGGGGTTT >RXA02310
GTGTCTACAACTTTTGATGTGTTGATCATCGGCGCGGGCCCCTCAGGTGCCAGCGCCGCC
GTCCATGCGGCCAGGACTGGGCTTCAAACATTGCTTATCGACGCCTCCTCCTTCCCGCGG
GATAAAACGTGTGGCGATGGCCTTACTCCCCGTGCGATTCACCAGCTAGAACTTCTAGGT
GTTGCTGATCAGGTTACCGGGGATTATTTCAACAAGGGCTTGAAACTGCATGGTTTTGGT
GGCTCTGTTGAGGCGCCGTGGCCGGAGACATATTTCACGAATAAGGGTTCCGCGATGTCG
CGGATGGAGTTCGATGATTTGTTATTCCGCTTGGCAAAATCTCATGAGGAAGTAACCACG
TGGGAGAACGCGAGCGCCCAAGACCCCATTTTGAGGGGGAATTTCTTGGAAGGCGTTGTG
ATTAATCACGCAGGGCAAGAGAAAACCGTCAAGGCGAAGCATGTGATTATTGCCGATGGT
GTCCGCTCCCCTTTCGGTAAGAAACTGGGTAGGCAGTGGCAACGCGATGAGGTGTATGGC
ATTGCGGCTCGTGCTTATTGTGAAACTCCGCTGTCTGATGAACCGTGGATTCACTCCCAT
GTGGAACTGCGCGATGAAGATGGTGTGGTGCAGCCAGGATATGGGTGGATTTTCCCGCTG
GGCAACGGCACGGTGAATTTGGGTTGTGGCGCGCTCTCGACGGATACGAGACCAGCGAAG
ATCAATACGAAGAAATTGTTGAGCTTCTATGCGGGTCAGCGTCGTAAAGCATGGCAACTC
GGGCCCGAGCACGACGTCGCCTCTGCCCTGCTGCCTATGGGCGGCGCGGTGTCGAATGTG
GCTGGCGCGAACTGGATGCTGATCGGCGATTCCGCCGCGTGTGTGAACCCGCTGAACGGC
GAAGGCATCGACTATGGCCTGGAAACCGCGGCGATGGCCGTCGACACGCTTGTGGAAAAC
CCCAAGCGCGATTTGACCTTGGTATGGCCACATAGGTTGCGCGACGCGTACGGCGAGACC
TTCATGTTGGCGCGCACGGCTGCTCGACTGCTGACGTACCCGCAGTTTTTGCCGATGGCT
GGGCCGCTCGCATTCCGCGGGCCGCTGCAAAAGGCCATCATGCCGGCGGCTGCGCGTTTG
ATGGGCAACCTGATCACAGAGGAGGATAAAGACCTGCTCGCCAGGGGTTGGCAGGCCGCC
GGATCCGCGATTAGTTGGGCGCGGAAGGGCTCCCCTCTGTGGGACTCGACTAGTTCTCTG
GTT >RXA02310-downstream
TAATCGCCGAGTGCAGCGCGACG >RXA02320-upstream
GTATGTTCACACAAGAACCCTGCACAACGCCTTCAAAGTACGTCGACCACGACCAAGCGC
ATTATTCACTCTCACCCTTCAGGATTTAGACTAAGAAACC >RXA02320
ATGACTGCAGCACAGACCAAACCTGACCTCACCACCACGGCTGGAAAGCTGTCCGATCTT
CGCTCCCGTCTTGCAGAAGCTCAAGCTCCAATGGGCGAAGCAACTGTAGAAAAAGTGCAC
GCTGCTGGCAGGAAGACTGCCCGCGAACGTATCGAGTATTTGCTCGATGAGGGCTCTTTC
GTAGAGATCGATGCTCTTGCTCGTCACCGTTCCAAGAACTTCGGCCTGGATGCCAAGCGT
CCAGTTACTGACGGTGTTGTGACTGGTTACGGCACCATCGATGGCCGTAAGGTCTGTGTG
TTCTCCCAGGACGGCGCTGTATTCGGTGGCGCTTTGGGTGAAGTTTATGGTGAAAAGATC
GTTAAGGTTATGGATCTTGCGATCAAGACCGGTGTGCCTTTGATCGGAATCAATGAGGGT
GCTGGTGCGCGTATCCAGGAAGGTGTTGTGTCTCTGGGTCTGTACTCACAGATCTTCTAC
CGCAACACCCAGGCGTCTGGCGTTATCCCACAGATCTCTTTGATCATGGGTGCCTGCGCT
GGTGGTCACGTGTACTCCCCTGCTCTGACTGACTTCATCGTCATGGTG >RXA02321
GAGTACGGTGGCATTCTGCGTCGTGGCGCAAAGCTGCTCTACGCATCGGNNGAAGCACCG
GTTCCAAAGATCACCGTCACCATGCGTAAGGCTTACGGCGGAGCGTACTGCGTGATGGGT
TCCAAGGGCTTGGGCTCTGACATCAACCTTGCATGGCCAACCGCACAGATCGCCGTCATG
GGCGCTGCTGGCGCAGTTGGATTCATCTACCGCAAGGAGCTCATGGCAGCTGATGCCAAG
GGCCTCGATACCGTAGCTCTGGCTAAGTCCTTCGAGCGCGAGTATGAAGACCACATGCTC
AACCCGTACCACGCTGCAGAACGTGGCCTGATCGACGCCGTGATCCTGCCAAGCGAAACC
CGCGGACAGATTTCCCGCAACCTTCGCCTGCTCAAGCACAAGAACGTCACTCGCCCTGCT
CGCAAGCACGGCAACATGCCACTG >RXA02321-downstream
TAAATCGGCGAATCCATAAAGGT Appendix A, page 57

Att / Docket No.: BGI-125CP

>RXA02335-upstream
TGGTTGAGTTCTTCGGGGTTGAGTGTGCAAGAATATTCACTATTGGTCAGGCAACTATGT
GTCTACCCACTGAGTCATCAATTTAAATCAGGAGTTATTA >RXA02335
GTGTCAGTCGAGACTAGGAAGATCACCAAGGTTCTTGTCGCTAACCGTGGTGAGATTGCA
ATCCGCGTGTTCCGTGCAGCTCGAGATGAAGGCATGGGATCTGTCGCCGTCTACGCAGAG
CCAGATGCAGATGCACCATTCGTGTCATATGCAGACGAGGCTTTTGCCCTCGGTGGCCAA
ACATCCGCTGAGTCCTACCTTGTCATTGACAAGATCATCGATGCGGCCCGCAAGTCCGGC
GCCGACGCCATCCACCCCGGCTACGGCTTCCTCGCAGAAAACGCTGACTTCGCAGAAGCA
GTCATCAACGAAGGCCTGATCTGGATTGGACCTTCACCTGAGTCCATCCGCTCCCTCGGC
GACAAGGTCACCGCTCGCCACATCGCAGATACCGCCAAGGCTCCAATGGCTCCTGGCACC
AAGGAACCAGTAAAAGACGCAGCAGAAGTTGTGGCTTTCGCTGAAGAATTCGGTCTCCCA
ATCGCCATCAAGGCAGCTTTCGGTGGCGGCGGACGTGGCATGAAGGTTGCCTACAAGATG
GAAGAAGTCGCTGACCTCTTCGAGTCCGCAACCCGTGAAGCAACCGCAGCGTTCGGCCGC
GGCGAGTGCTTCGTGGAGCGCTACCTGGACAAGGCACGCCACGTTGAGGCTCAGGTCATC
GCCGATAAGCACGGCAACGTTGTTGTCGCCGGAACCCGTGACTGCTCCCTGCAGCGCCGT
TTCCAGAAGCTCGTCGAAGAAGCACCAGCACCATTCCTCACCGATGACCAGCGCGAGCGT
CTCCACTCCTCCGCGAAGGCTATCTGTAAGGAAGCTGGCTACTACGGTGCAGGCACCGTT
GAGTACCTCGTTGGCTCCGACGGCCTGATCTCCTTCCTCGAGGTCAACACCCGCCTCCAG
GTGGAACACCCAGTCACCGAAGAGACCACCGGCATCGACCTGGTCCGCGAAATGTTCCGC
ATCGCAGAAGGCCACGAGCTCTCCATCAAGGAAGATCCAGCTCCACGCGGCCACGCATTC
GAGTTCCGCATCAACGGCGAAGACGCTGGCTCCAACTTCATGCCTGCACCAGGCAAGATC
ACCAGCTACCGCGAGCCACAGGGCCCAGGCGTCCCGATGGACTCCGGTGTCGTTGAAGGT
TCCGAAATCTCCGGACAGTTCGACTCCATGCTGGCAAAGCTGATCGTTTGGGGCGACACC
CGCGAGCAGGCTCTCCAGCGCTCCCGCCGTGCACTTGCAGAGTACGTTGTCGAGGGCATG
CCAACCGTTATCCCATTCCACCAGCACATCGTGGAAAACCCAGCATTCGTGGGCAACGAC
GAAGGCTTCGAGATCTACACCAAGTGGATCGAAGAGGGTTTGGGATAACCCAATCGCACCT
TACGTTGACGCTTCCGAGCTCGACGAAGATGAGGACAAGACCCCAGCACAGAAGGTTGTT
GTGGAGATCAACGGCCGTCGCGTTGAGGTTGCACTCCCAGGCGATCTGGCACTCGGTGGC
ACCGCTGGTCCTAAGAAGAAGGCCAAGAAGCGTCGCGCAGGTGGTGCAAAGGCTGGCGTA
TCCGGCGATGCAGTGGCAGCTCCAATGCAGGGCACTGTCATCAAGGTCAACGTCGAAGAA
GGCGCTGAAGTCAACGAAGGCGACACCGTTGTTGTCCTCGAGGCTATGAAGATGGAAAAC
CCTGTGAAGGCTCATAAGTCCGGAACCGTAACCGGCCTTACTGTCGCTGCAGGCGAGGGT
GTCAACAAGGGCGTTGTTCTCCTCGAGATCAAG >RXA02335-downstream
TAAGTTCTTGGATTCCTGTTAGT >RXA02343-upstream
TTTAAAAACTACCCGCACGCAGCACGAACCTGTTCAGTGATGTAAATCACCGCGGAAATA
TTGTGGACGTTACCCCCGCCTACCGCTACGATTTCAAAAC >RXA02343
ATGACCATTTCCTCACCTTTGATTGACGTCGCCAACCTTCCAGACATCAACACCACTGCC
GGCAAGATCGCCGACCTTAAGGCTCGCCGCGCGGAAGCCCATTTCCCCATGGGTGAAAAG
GCAGTAGAGAAGGTCCACGCTGCTGGACGCCTCACTGCCCGTGAGCGCTTGGATTACTTA
CTCGATGAGGGCTCCTTCATCGAGACCGATCAGCTGGCTCGCCACCGCACCACCGCTTTC
TGCCTGGGCGCTAAGCGTCCTGCAACCGACGGCATCGTGACCGGCTGGGGCACCATTGAT
GGACGCGAAGTCTGCATCTTCTCGCAGGACGGCACCGTATTCGGTGCGCGCTTGGTGAG
GTGTACGGCGAAAAGATGATCAAGATCATGGAGCTGGCAATCGACACCGGCCGC >RXA02364-upstream
GCGAAAGTATCTAAGGTCGTTTGATTGGTTTACTACCCCCGAAGTGGGGGTTATTGGCAG
CATCGAGCACCAAATGAGCGTGATCCGGGATCAGGATCTG >RXA02364
ATGGAGCCACTGTTCCAAAGTCTTGCGGAATCGGACAATATTTCTGTCATTGGTGGATTT
ACCCAAGGCACCCGAAATCTGTACACCACTGATGCGCCGGTGAAAAGACCCGCTGACCTG
GCTGGAAAGAAGATTCGCGTCCAGGAATCCGCCATGCACATCCGCATGATTGAACTCATG
GGTGGCTCGGCAACCCCGTTGACTTACGGCGAGGTATATACCGCGATGCAGTCTGGTGTG Appendix A, page 58

CTGGATGGCGCGGAAAATAACGAGATCAGTTACGTTACCCAAAACCACTTCGAGGTTGCT
CGCTACAACAGCAACACCAATCACCTTGTCGGTTTGGATTACATGGTCATGCGACACGAT
CTGCTTGACGCCATGAGCGAGCCAGACCGTGAATTGTTCCTGGAAGAATGGGACGCCGCG
ATGACTGAGCACACGGATCTGTGGAACACAGAAACTGATGCCGTTATTGAAAAGGCGAAA
GCTGGGGGAGCGGAGTTCGTTGAGGTGGATGCGCAAGCATTTACCGATGCACTGGCTCCC
ATCAAAGACGAATTCTTGACCTCAGAATTCCAGCGTGAACTCTACGAAGCAGTGCGCGCC
GCTGATACTTCAGGAGGTGCGGCATCA

>RXA02364-downstream
TGATGAATTTTAAGTCCATCGTG

>RXA02372
GATGCGGTCAACAAGATGGATCGCACCGACTTCGTAGAAACCTTCGCACCGCTGTTCAAC
AGCAAGACCTGGCCTTTGGAAACCGCATGGGAATCCCAGCCATTCGCCAACGTCACGGAA
CTGCGCGAAGCCATCCAAGTCGCTGTGCTCACCGCACCGTTGTCCGACCGCGAAGAGCTC
ATCCACGACTACCCCGACATGGCACAGCTCATTTTGGCCACCGAAGAGGAAGCCGCCACC
ATCTCTCAAGACCGTGGTTCGATCGGTCTTGATGATCTCGATGACGTGGATCAAGAAAAG
CTCATCACCGTCACCGAGCAGTACCGCGAACGGTTCAACATGCCGTATGTTGCGTACTTC
GACACCATGGATTCTGTGGATACCGTCGTAGCCGCCGGCTTGCGCCGCCTCGACAACTCC
GACGAGCAGGAGCACCGCCAAGCGCTATCGGAAATCATTGAGATTGCCAATGACCGCTTC
GATATATTGCTTGCCGACGCTAACCCAGCCCGTTCAGCTTTCGATCGCAAGTTTACCGAG
ACTGACTTCCTCGGC

>RXA02372-downstream
TAAAACACCAAAAACAAATTAAG

>RXA02377-upstream
GACAATACTGATGGATAAATTTCATATCGAGGACGAAGGGACAACCCCGAACGCCGTGAC
AACATCAACCACAACCCGGGTGAAACATCCGGTAGACCAG >RXA02377
GTGCCACCCGCACCCAAACTTGCAGCCCTAGGGCTCCAACACGTTCTTGCTTTCTACGCA
GGAGCCGTCATTGTTCCGCTGCTGATTGCACAGTCGCTGAACTTGGACACTGCGACCACC
ATTCACCTGATTAACGCTGACTTGTTGACATGTGGCATCGCCACGTTGATTCAGTCTGTG
GGCATTGGTCGCCACATTGGTGTGCGCCTACCGATCGTTCAAGGTGTCACCACTACTGCT
GTTGCTCCCATCATCGCCATTGGTTTGGGCGTTACTGATGGTCAAGGTGGCGTTGCGTCG
CTGCCTGCCATTTACGGTGCAGTCATTGTCTCCGGCATTTTCACGTTCTTTGCAGCGCCG
GTGTTTGCGCGTTTCCTCAAGTTCTTCCCACCAGTTGTCACCGGTACTGTGCTGTTGGTT
ATGGGTGCTTCCCTGCTGTCGGTATCTGCAAATGACTTTGTGAACTACGCCGATGGGGTG
CCTGCTGCCCGCGATCTTGCTTACGGTTTTGGCACCTTGGCGGTGATCATTTTGGCGCAG
CGCTTCTTCCGTGGATTCATGGGCACCTTGGCTGTGTTGATCGGCCTGGTTGGTGGCACC
GCAGTTGCTCTGATCTTGGGCGATGCCAACTTGGATGAGGTGGGAAATGCTGAAGCGTTC
GACATCACCACTCCGTTTTATTTTGGTGTTCCAGAATTTAACGCTGTTGCCATTTTCTCC
ATGATTATCGTCATGATCATCACCATGGTGGAACACCGGTGATGTGTTTGCAACGGGG
GAAATCGTCGGCAAGCGAACTCGCCGCAGTGATGTCACCCGCGCACTGCGCGCTGACGGC
CTGTCCACCCTGATGGGTGGCGTCATGAACTCCTTCCCGTACACGTGCTTCGCGCAAAAC
GTTGGCCTGGTGCGCATCACGGGCGTGAAATCTCGCTGGGTTGCGGCAGCTGCTGCCGGC
TTCATGATCATCCTCGGTGTGCTGCCCAAGGCTGGCGCGATCGTCGCTTCCATCCCTTCC
CCAGTCCTCGGTGGGCATCCTTGGCACTGTTCGCCAACGTTGCATGGGTGGGCATCCAG
ACCATCGCCAAGTCTGACCTCGCTGATAGCCGCAACTCCGTCATCGTGACCTCCGCACTT
GGCCTAGCCATGCTGGTGTCCTTCCGCCCCGATGTTGCTCAAGGCGTTCCC >RXA02377-downstream
TGAGTGGGCGCGTATCTTCGTCT >RXA02397-upstream
GTGTGAATAAAACTTGTTTCCTGGTCATTTCCCCTACTGAACTGCGCTTATGCCTATGCT
TAGAAACCAGAGACAAGCTTAAGAAGGACAGGGGCCGGCC

>RXA02397
ATGAATGATTTCGAAACAACCATCGATCGGATCTCTAAAGAACAAGATCCCGCAGCCCGA

Att'y Docket No.: BGI-125CP

```
AGCCGCGTGGAACAGTTCATTGTGGAAACAGTACGTGCACTACCCAACTTGACCACCAAA
CAAGGTGCATCGTTGGCTATCCAACTTCTTGATGCGGTACAGCTCGCGGATGCGGCGGGA
ACCAAGGGGGGTGCGTCGACAAGCAATGCTTCATCGCTGCCTGACACCTTTGACGCGCTG
ACCAGCCTGATTGGCAAGCTCGATGTGCGCAGCGATTCTGAATGGCGCTCGTTTGGGTTC
CAGCCTTCTGAAACTGCGCACCCGCTAATGATCGCTATCCCTGAGATTGAGATTTTTTAT
CAGCACACCGATGTGGAGCCGGGAAGCGATGACGCCGTGGCGCCGGACTTTCAGGAAAAT
CAGGATATGTGGCGCAGGCGTCTCGGATCTGTCACCGAACCAAACCTTATATATAAAGAG
TTTTCCGGACCCGGCAAAGCGCAGCGTGCCGTAGAAATGCTGGGCAATCTGTGGAAGATC
GGCGTGGTGGTGAGTAGGAATACGGAAAGTCGCCTTGGGTTAACTCGTGTGGAATACACC
CCCACCCCTGGCGAAGTACCCGTGCCGCTGATGTCGGAGAAGAACTGTTGGTACAGCATT
CGGGTGTCTGAAACCATTGGTGAGAACCAGGTTCCGGAAATTGTGCGCTGCTTAGGCGAG
ATTTTCTGTGGCTATCTTCCCCAGATGTGGCTCAAAGAACCAGTAAAGGCCGGCAAGTTG
CGAATCCAAGAATCGGAAGCAGCAGCGTATATCGCGATGGCGCGACTAGATCTTTCCCCA
CGCACCGGCAACACCACTTGGACCAACAGCTATATTTCCACGCGTCCTCTCTCCCCCGCT
TTTAGGTGGGACGTGGTGCTGGAGGCTTCCCACCAATTGGAGAACCTGCTGCGTGGAGAC
ACAGGGCCGGTCACTGCCACACAATCGGCAGCTGGT

>RXA02397-downstream
TAACCAAAAGTTCACGTGGAGAT

>RXA02424
ACCGGAGCAACTCACTACGCGCCTTTCCTTGAGGTGCCAGCTTTGCCCTCCGCTGTTGAT
GTGGAACTGCATCATGGTGATTCAATTGAATTTGAGGGTCATGTATTCCCTATCAGCATT
CTGCGCGGCCACACCCCAGGCGGTGCAGTACTCACCGCTGAGATCGACGGTAAAACTCAC
CTTTTCGTGGGTGACAGCCTCTTCCCCGGCGGTTTGGGCAAAACCAGCAGCGAAGGCGAC
TTCGTCCGACTGTTCAACGATGTCAAAGAGCGCATCTTTGACACCTACGACGATGACAGC
ATCGTGTGGCCAGGTCACGGCAAGGAAACCACCCTTGGAGCCGAGCGTCCACAGCTGGAA
ATCTGGTGGGAGCGTCGCTGG

>RXA02424-downstream
TAAGCGCTTTTCTCAACCAGGCA

>RXA02426-upstream
TGCAGCAGCATAATCAGGGAAAAATAGGAACTGTTTACTGAAAAACTGACAAACCTGACA
GACCTGACCCGAAGAGACCTTATTCATGACGATATTGTTC >RXA02426
ATGCTCATTACATTGCTGCTCGCCACCGTGATTGTGGTGGCCATCGGCGATAAAACCGGA
CTCCCCTGGCCTGCTTTGATGACTATTGTCGCCGCAGGTGGAGCGTTGTTGCCATTTTTG
CCGGAATTTACTATCCCGGCCGATCTGATGTTGCCTATTTTCATTCCGCCGCTGCTGTGG
GCGCTGGCGAGGAAGTCATCGTGGGCGGTGATTAGGTCGCAGATGTCTACCATCATCACG
ATGTCGGTGTTGTTGGTGTTCGTGACCATCGCGGCACTCACGGGTGCATCCATGCTGTTG
CTTCCTGGCATTGGTCTTGCTGGTGCGATCATGTTGGCTGCGGCTATTGCTCCACCGGAT
CCTGTTGCTGTTGATGCAGTGGCGGAACCTGCGGGAATCCGAAGCGCATCACCACCACT
TTGCAGACGGAGGGTCTGTTTAATGATGCAGCCAGCATCGTGGCGTTCCATGTGGCTTTA
GCTGCCCTGGTCGCTGGTGAGGATTTGTCCTGGTCAACGGGTGTTTTGGAATTCTTGTGG
TCGTGTCTTGCTGCCGTTATTTTGGGCTTGGTTATTGGCCGGGCGGCTGCGTGGTTTACC
GATCACGTGAGTTCCGTTGAGGCTCGAAATGCGTTTACGTGGGTGCTGCCGTTTGCCATT
TATGTGGTGGCGGAAGAAATCGGCGGATCGGGCGTTATCGCCATTGTGATCGCTGCAGTG
GAGATGAATTCGAGGGCGTCGATTGGTGCGGAGGATCGTCTAACGGGTTCTGCGTTCTGG
GGAACCATTGAGGTGCTGTTTACTGGCGTTGCCTTTGGTTTGATCGGCCTGAATGTGCGC
GCTGCGATTGATGAAGTTGGATCTGAGCTGTGGCATGCCGTGGTCGTGGGCATTGTGCTC
TCGGTGGTGGCGATCGTTGTCCGTGGTGTGTGGATGTTCGCGGCGTATAAGCGCAATCGT
TTCAAGATCGATAAGAAGGGTGCGACCAATAGTTCATTGCGGGCGCCTCTTCGACTGCAG
GAATCGTTGCTGATGACGTGGGCGGCATGCGCGGTTTGGTGACGTTGGCGCTGGTGCTG
TCTATTCCGGAGGATATTTTCCCGTATCACCACGAGTTGCAGGTCATTGCGCTGGTCGTT
CTCTTAATCACCATGGTGGGCCCTGGTTTGACGTTGCCGTGGCTGATGCGGAAGCTCAGC
TTGGATAAGGGTCCCGATGCTGCGGGCGATGAGAGTATCGCCGCGCTGACAGAGAGGCT
CACAAGGCCGCAACAACGTATTTGGTGGATACCACGGAGTTGCCGATGGAGCAGATGGTG
GCGATCAAGAATTGGTTCTCGCAAGAAATTGACGCTGATGAACTGCAGGAGAACGTCGAT
AAGCTGCATCAGCGCGCGCATCATGCGCGTGTCGGGGCAATTAAGGCGGCCCAGGAGGAG
```

Appendix A, page 60

```
CTGTTGAAGGCGCGGCGGGAGCGCGGCGTTAATCCGGCCTATGTTGATGAGGTGTTGACC
AACATTGACCGGATGCTTGTTGCGGCTGAACGC

>RXA02426-downstream
TAGATAAACAGCAGCAGGCTGAT

>RXA02487-upstream
GGCGAGTGGTACCGCACCGCGACGTCGGAGTGATGAAGAAGCCGGGTTCATCCGCCTAGT
TGCTCGCATCAAGAAAGTCATCATCACTGGCGGTTTCAAC >RXA02487
GTGTACCCAGCTGAGGTTGAAGAAGTCCTCGCAGAGCACCCAGACATTGAAGATTCCGCA
GTCGTTGGTATCCCGCGTGAAGACGGCTCCGAAAACGTCGTTGCTGCCATCACTTTGGTG
GAAGGTGCAGCGCTGGATCCGGATGCCTGAAGGAATTCGCCCGCAAGAACCTCACCCGC
TACAAGGTTCCGCGCACTTTCTACCACTTTGAGGAGATGCCGCGGGATCAGATGGGCAAG
ATTAGGCGTCGTGAAGTGCAGGCGGAGTTGTTGAAGAAGCTCGGCAAG >RXA02487-downstream
TAGACGCCGATTTAAGAGGTCGA >RXA02490-upstream
TCATAGCTACGCGCATGCCCACATTCTAGATCGCCGAAGAAAGCAGCGGGACGTCTCTAT
ATACTAAAGGGCACTAAAGCAACGCAGTTGAAGGGACACC >RXA02490
ATGTCAGCATACGAAACCAAAGAATGGCTCCAGCACTACCCAGAGTGGACGCCACACTCG
CTGGAATATGGCGACACCACCCTGCTGGACGTTTACGACAACAACCTGGCCATTAACGCA
GACAAGCCAGCCACCTACTTTTTCGGTCGTTCACAAACCTACGGTGAACTGGACAAAGAA
GTCCGCAAAACTGCCGCTGGCCTGCGCGCACTAGGTGTCCGCCCCGGCGATCACGTAGCG
ATTATCCTCCCCAACTGCCCACAGCACATCGCAGCTTTCTACGCAGTGCTGAAACTCGGC
GCAGTAGTCATTGAGCACAACCCGCTCTACACCGCCCACGAACTGCTCGAACCCTTCAAA
GACCACGGTGCCCGCGTTGCCATCGTCTGGGACAAAGCCTCCCCCACCGTCGAACAGCTA
CGTGGACAGACCCAGTTGGAAACCATCGTGTCGGTCAACATGATCAACGCGATGCCACCA
CTCCAGCGCCTAGCACTTCGGCTCCCAATCCCTGCACTGCGCAAGAGCCGCGAATCCCTC
TCCGGCGCAGCCCCCAACACCGTTCCTTTTGAAACCCTGACCAGCGCAGCAATGGGCGGC
GACGGCGACGACGTAGTTTCAGAACCCACCGTGACCAAAGAATCCGTCGCGCTGATCCTC
TACACCTCCGGCACCACCGGACGCCCCAAGGGTGCCCAGCTCACCCACGGAAACCTGTTC
TCCAATCTCCTCCAAGGAAAGCACTGGGTTCCAGGTCTCGGAGACAAACCAGAACGCATG
CTTGCAGCCCTACCAATGTTCCACGCATACGGT >RXA02511-upstream
CCATGCTTGCGCAAGCATGGGGCACCATTGATGGGGCACCAGGCACTGTCGACCCAACGC
TGACTTCAGCGATCCGTACCGCAGCACCGAAGGAGCACTG >RXA02511
ATGCTGGGACTTCATGGACGTAAGCCTGCGCAGGTTATTGTTGAGCCTGTTGCCAAATTG
ATGATCAAGTTGAAGGTGACGCCTAATCAGCTCACCTTAGTCAGCGCTGGCCTCACCGTT
GGGGTGGCTTTGCTGCTGATTCCTACGGGGCATTTGATTTGGGCGGCAGTTTTGACGGGC
CTGTTTGCGGCTTTCGACATGATTGATGGCACGGTTGCTCGCATGCAAGGTGGTGGCACC
AAATTTGGTGCCACCTTGGATGCCACGTGTGACCGCATCACTGATGGTGCACTATTTGGT
GCGATTACCTGGTGGCTGGTGTATTCCTACGATGCACCACAGGCATTGGTCGCTGCCTCC
TTGGTTTGTTTGGTTGCCTCCCAGGTGATCTCTTACGTGAAAGCCAGGGGAGAGGCCTCC
GGATTCACCATGGACGGCGGTCTCGTGGAACGCCCTGAGCGTCTGATTGTCAGCCTTGTT
GGTTTGGGGCTGACCGGAATGGGCGTTCCATATGCCATCGATGTGGCACTGTGGGCCCTT
GCAGCTGGCAGTATTTACACTGTTGTGCAGCGCTTGGTCATGGCTGGAAAGTCCCCATTG
GCTAAGGAATTTACCAAGGCACCAGCAGGTGCGAAGGCAGATTACAGCAACACCAAA >RXA02511-downstream
TAAAAATTAGCCGAGGGAGCATC >RXA02512-upstream
```

Appendix A, page 61

Docket No.: BGI-125CP

GCTGGAAAGTCCCCATTGGCTAAGGAATTTACCAAGGCACCAGCAGGTGCGAAGGCAGAT
TACAGCAACACCAAATAAAAATTAGCCGAGGGAGCATCGC

>RXA02512
ATGAAGCCGAAGGATTTCTGCACAGCGGAAAATTGGGCGGAGAATTTAAGCGCACTGGGC
TATCTAGCTGGTTGGCGTTTTGTCCGGATGCTCCCTTTGCCTATTGCTCGCCGGGTGTTT
GACCTTGGGGCGGATCTGGCGTCGAAAAGCGGAAAAGGCATGGGGCAGCTACGCGCTAAT
CTGGCGCGGGTGGTCGGTGCGGAAAACGTTACGCAGGCGCTGGTGAAGCAAGCAACGCGC
AGCTATGCGCGGTATTGGCTGGAAGCGTTCCGGCTACCGGCGATCGCGCGAGATCCTGAG
CTGCTTGCGCGGTTGCGTAAGGGAACTGTTGGCCTAGATTTGTTGGATGAATCTTTGGCT
GCCGGCAAGGGCGTAGTTTTGACGCTCCCACACAGCGGCAACTGGGATATGGCTGGCGCT
TTTCTGATTAGCCATCATGGGCAATTCACCACCGTTGCAGAAAGGGTCAAGCCGGAACGC
TTGTTTGAAGCGTTCGTGGAGTTTCGAGAAAGCCTTGGATTTGAGGTGCTGCCTCTCACC
GGTGGCGAGCGTCCGCCGTTTGAAAAGCTGAAAGAGCGCCTGACATCTGGAGGTATCGTG
TGCCTTCTTGGGGAGCGTGACCTGCGGCATTCCGGCGTGGAGACCACTTTTTTTGGTGAG
AAGACCTCCATGCCAGCAGGACCTGCGCAGCTGGCCATTGAAACAGGTGCGGCGCTGCAC
GTGGTGCATCCATGGTTCGATGACGACGGCTGGGGTCTCAGCGTATCCGATGCCGTGACC
GTGGATAATTTATCCGACACGGTGCAGCGGATCGCACATCTTTTTATGGCAAATATTACG
GCGCACCCCGCTGATTGGCATATGCTCCAACCCCTGTGGTTTGGTGATTTGGATCCGGAG
CGTCTCAAGCGCTCTAGGGAGCAGACAAATGTTCACAAACCGGTGGCATTACAGGAG

>RXA02527-upstream
ATTGGAGCAATCTTTTAATCAAGTTGGGAATTCCAGCGTTGATTGTGGTTGCCATGTGGT
TTGCCCGCACCCTGAAGCACTCACGGATCAAGCGTGGCGG >RXA02527
ATGTTTGGCCTGTTCATCGCGACGATTGTGGCGATTATTCTCAAGCCAATGCCAATGGGT
GCCGTGACAATTATCGGCATGATCGCCGCGGTGTTGACTGGTTTGGTGCCGTTGACGGCG
TCTTCTGATGATCCCGGCGCGGTGTATGGCCTTATTGGTTTCAGTAACGGCACCATTTGG
CTGATTGTGATGGCGTTCCTGATTTCGCGTGGATTCATCAAGACGGGGCTTGGACGTCGA
ATAGCGTTGTTCTTTGTGTCTAAAGTCGGCGGAAAAATGCTGGGTGTGACCTATGGTTTG
GCGCTCGCTGATTTGGTGTTGGCTCCTGCGATTCCATCAGCAACTGCCCGAGGTGGTGGC
ATTATGGCTCCGATTATGAAGTCGGTGGCATTGACTTATGATTCCACTCCTGGCCCAACT
CGTCGCAGGGCTGGCGCGTTCTTGGCGCTGAATGTGGGACAGGTAAATGCGATTACGTGC
GCGATGTTTCTAACTGCAATGGCAGGAAACCCCTTGATCGCCTCTTTGGCTTCGCAGATG
GATGTCAATATCACGTGGACAAACTGGGCTGTGGGTGCGATTGTGCCTGGTCTGGTGGCG
CTTATTGTGGTGCCGTGGGTGGTATACAAGATCTATCCACCTGAGTTGAAGGACACCCCT
GAGGTCAAGAAAATGGCTTCTGATGAGCTCAAGCAATTGGGTGGGTTTACTTATGGTGAG
AAGGTGCTGGCGGGAACCTTTGTTGTGTTGCTGCTGCTCTGGACAGGTGGCGATTTGGTC
TTGGGAATCTCGGCAACTACCACCGCTTTCGTTGGCGTCATCATCTTGCTAGTGGCTCAC
GTGCTGACGTGGGAGGACATCATTCAAGAAAAGACTGCGTGGGACACCATGGTGTGGTTC
GCGGTGCTATACATGATGGCAACAGCGTTATCGCAGTACGGATTCATCGCATGGATCTCT
GAGGTAATTGCTTCCAGTTTGGGTGGCATGAACTGGGTCGTTGCTTTGGTTGTGTTGGTG
CTGATTTACTTCTTCAGTCACTATTTCTTTGCCTCGGCAACAGCGCATATTTCTGCGATG
TACTTGGCCTTCCTGGGTGCTGCGATTGCGATTGGTGCACCCCCGTTGATGGCGGCCCTG
GTGTTGGCGTACACCTCCAATTTGTTCTCTTCACTCACTCAGTATTCTGGTGGTCCTTCG
CCAACATTGTTTGGTTTGAACTACATCACGGTGGGTGAGTGGTGGCGGACCTCGGCAATT
GCTGGCGCGGTATCGATTACAATCTGGTTGGTTATCGGTGGTTTGTGGATGAATGTCATC
GGACTCTGG >RXA02527-downstream
TAATCGAAAATTAAAGGTAAGGG >RXA02547
GCTGCGCGGCTGACCGTGGATGAGTATCCGGCGGCGAGGGAAGCGCTTGAATCTGCAGGT
CAGAGGAATGTAGAGGACCGAACCCGTGCGGTTGATGAGTTCAAAGCGGCGGATCAAGAG
CTGTCTTCTTTGAGTAAAGGCAGCAGTAATATTGAGTACCGTTTGCTGCAGGTGCGGGAA
AATTTGTGTCAGGATTTGGGCGTGAGCCCGCGGGATATGCCCTTTGCCGGTGAGCTGATT
GATCCGAATAATGCGGAATGGGAACCCGTTGTGCAGCGCATTTTGGGTGGTTTTGCTGCG
GAAATGTTGGTTCCTCATGGGTTGTTGCCACGGGTTCGGGATTGGGTAAATGCCAAACAT
TTGGCAGCGCTGCTGAAATTCAACGGCGTGGTGACAACGGGGGAGTACAAAACCTCGCGT Appendix A, page 62

```
TTTCCGGCGGATTCCCTGATCCGAAAAGTTGATGTTGTGGAGTCGCCGTTTCGCGATTGG
GTAAATCAAGAATTAGGCAAGCGTTTTAATATTCGGTGCGTGCGCACTCCTGAGGAATTG
TCGGCGCTGGGGCCACGCGATCAGGGCGTGACCATTTTGGGTGTGCGAAAATTTGCGCAG
CAGACAGGCGATCCGACGACGCGTTGGGAAAAAGATGATCGCCGAAAGCTGGGGGATCGT
TCCACATACCGTTTGGGTTCCACCAATGATGCCAAGGTGGAAACGCTTCGGGAAACCGTG
AAAGCTGGCAAAGCAGTTGTGCAGGCAGCTGATAATCGCATTGCTGCAAACCGCGCTGAG
CTGCGGGAACTTGAACGGCAGTATCAAGCTTCGCAAGAAATTTTGAAAGTGTCGTGGGCT
CAGATTGATGTGGAATCAGCCGACGCGGCGATTGCTGAGCTGGACCGATTGCTGGAAGAG
CTGAACAACACTCCAGAGGCCACCGAGCTTTCCGCGCGGCATGAGGCGGCGAAGCAGACG
CTCGCGAGGGTTTCTGACTTGCTTGTCGCAGCTCAGAGTGAGGAAACCGTGGCGTCGATG
AACCTGAAACGCGCCGAAACTGAATTGAAACGGCTCGAAAGCCTGCCGGTTGCGGAGGTT
TCTGAAGAAATCGCGCGGGAAGTGGAGAAACTATTTCTTGCCAACACCCGCCGGGTTCAC
GCCGCCAACGTGGATGAGCAGACCATTGCGCTGCGCGAGGATCTGGACAAACAAATCGAT
GCCAATGAGGCAGAACTTCGACGTTGTGAAAACCAAATTGTTGGCATTTTGCGCAGCTAT
ATTGAAACGTGGCCTGCGAACCGCGCTGACTTACAAGCCGAACCTGAGTTTGTTGGTGAG
GCCATCAACCGCCTCGGCGAGCTTCGCAGCGATCGTTTGGCAGAATTCACGGCCAAATTC
CTAGGGCTCATGAACGAGATGTCCACCCGAAACCTCGGCCAAATCTCGCGGCGTCTACGT
GATGCGCGCCGGGAAATCGAGGAGCGCATCGAGCCGATCAACGCCTCCTTGGCGCAGTCG
GAATTCAACGAAGGTCGCTTCCTGCACATCGACATCCGTGATCAAAGTGGTCCGATTGTG
AGGGAATTCCAGCAGAAACTTGATGCCGCTACCAGCGGTGACCTGGGAACCAGTACCGAG
AAACAAGCCTTCGCCCGTTATGCGCTGATCGCTGAAATCATTTCCAAACTCGCCTCCCAC
GACTCCGCCGACGCCCGCTGGCGCAACACCGTTCTAGACACCCGCCGCCACGTTCGCTTC
ATCGGCCTCGAGCGCGATTCCGACGGCGCAACCGTCAACACCTACGTCGACTCCGCATCA
CTTTCAGGCGGACAAGCCCAGAAGCTGGTGTTTTTCTGCCTCGCCGCTGCCTTGCGCTAC
CAGCTAGCCGAACCCGGCGCCCATTATCCCACCTACGCCACCGTCATTCTGGACGAAGCC
TTCGACCGCGCCGACCCCGCCTTCACCCGCCAAACCATGAACGTCTTCCACAGCTTCGGC
TTCCACATGGTGCTCGCGACCCCGCTGAAACTTATCCAAACCCTCGGCGATTATGTCGGC
TCCACCATCGTGGTCAGCTACACCGAAAAACCAAACGCCCAGGGCGCAATTCAGGGCAAT
TCCAGTTTCTCTAGGATCGAGAAA

>RXA02547-downstream
TAACATGCCATTGTTTATCGACG

>RXA02561-upstream
ATCTGCTCAATAACCTAACCTAAAGTCCATGCACGCCTCGTCGCCCAACCTCACCCTCA
GCGCACCCGTGTTCTCAGCGGCCTGATTTTCGCCCAAATC >RXA02561
ATGGTTGGTGCATCCAATGGCGTGACGCTATCGATGGGAAGTTTGCTGGCAGCACACTTG
GCGGGAGCTTCGTGGGGAGGATCAGCCGCCACATTGACCACGATCGGCGCAGCTATCTTT
TCGATTCCCCTTGCCCGCATGGTCTCCACATACGATCGCCGAACTTCACTCAGCACGGGC
ATGTTGCTTGGTTGCGTGGGCGCACTACTGGCGATCCTCGGCGCACAATTCGGCTTGTTT
CCAGTAGTACTTTTGGCATTTTTGTTCCTCGGATCCATGTCGGCGGTTAACCTCCAAGCA
CGTTTCGCCGCAACCGACGTGGCCAGTGAAGAAACCCGCGGCCGCGACCTCTCGATCGTT
GTGTGGTCCACCACCATCGGCGCAATCGCCGGACCAAATTTATTTGAACCAAGCGCCCGA
TTCAGCGAAACCCTGGGCCTCGAACAACATGCCGGCGCATACCTGCTGTGTTTATTTGGC
CAGCTCATCGCCATCGCAGTCTGGCGATTCACCCTCCCCAAAGGCCTCAAACCCGAAGCC
ACCCCAAATGCACCAACAGAAAAGAAGCGCCTCACCCCGAAAGCCCTCCAAGCCATCACA
TCGGTTGCAACCGCACACTTCTCCATGGTCGGTCTCATGTCCATGGCCGCCATCCACATG >RXA02566
ATCAGTTTGCACGTCGCCGGAATGTACGCACTCTCACCAGTGTTCGGCCTGCTCACAGAC
AAACTCGGCCGCAATGTCACCATCTATCCGGCTTCGCCATGCTCGCCACATCCGCAGCA
TTTCTTATCATTTGGCCCGAACCACAGTGGGCCATGATCACATCCATGATCCTGCTTGGG
CTCGGCTGGAACTCTGCCCTCGTCGGTTCTTCAACATTGCTTGTCGACGCCACCCCCATC
CACCACCGCACCTACGCCCAGGGGCGCAGCGACCTAACGATGAATCTTGCGGGAGCTTCA
GGCGGGTTGATCGCCGGACCGTTAATTGCCATGGGCGGAATGCCCTTGTTGGCAGGCGTC
GTTCTTGCAGTTGTGGCGCTTCAAACGGTGCTTAGTTTCAGAACCCGTTCAATTGAAAAG
ACTCCTGCTTCATGTTTT >RXA02566-downstream
```

TAGCCTAGGAATTCACGCACGAC

>RXA02571-upstream
TGGACAGGCCGGGGCCGCGTACGGTGTTGGTTGAGGTGGTGGAGGGGCGCGTCGAAAAGC
ATTGTCGCTGGTTGTTGCCGCTTTTGGCAGTCGGGATGGC >RXA02571
GTGGTGGCTCTAACTCAAATCGTCGGACCGTCCGGCTCCGGGCTCACGCGGGAATTGGAA
AAACGCTACCGGGAAACGCCCGGAGCGGTGATGCTGACCGCCGACCCGCGCGCGCATATC
ACCTACCTGCGCGCGACAGTCGCCGAGGAGCTGGCCTTTGGGCTGGAACAACGCGGCATC
GTACCCGCGCAGATGTGGGAGCGCGTCCGAAACATCGGGCTCGGCCTCGAGAATCTGCTA
GACCGCGCACCCGCGCAACTTTCCGGCGGGCAAACACGGCGGCTGCCGATCGGCACCGTC
GCCATCTTAGAGGCGCCAACGATGCTTCTCGACGACCCCCTCTCCGGTCTTGATACCTCC
TCGCGAGCCCAACTCATCACAATGTTGGAATCATATGAGGGCGATGTCATCGTCGCTGCG
CACAAGCGGTGGCTCGACGCGCCGACTGTGTACTTAGGGGATTTGGAGGAGCTGTCCCTG
CCTGCGCGGGTGGAATTTTCCGGTCCATCGCGAACGTTTTCAGCGATTACAGGAACCCGC
GGACAACAACGCCGACGCTGGTGGCAATTCAACGAATCCCAACCACAGTTTCAGATCGGC
CCCCTGGATATTACTGTTTCTGCAGGTCAAGTGCTGTGGTTGCAGGGTCCCAATGGTTCA
GGGAAGTCCACACTCCTGCGTGGTCTTGCCAATGAACCCGGCACTGAATTGATGCTGCAA
AACCCTAGCGATCAAGTCATTGACTCCACTGTTGCTAATTGGGTGCCAGGCAGTAACAGT
GAAGAACATCCGCTGGATTTATCGCAACGCGAACTCCGCCTTGCCCAATGCGACGCAGCC
CTGGGTAATAACCCGGAAGTTTTGCTTGCTGATGAACCCGACGTCGGCCTTGATGTCGGC
GGTCGAAACGCCATCCACCAGCGCTTTGCGGATTTCTTAGGGAATGGGGGAGCGCTGATC
CTGACCTGCCATGATGAAACCTTCGTGGCAGAGGTAGCTGAATACGCGATAGTGAAGGAA
ATGGGGCTC >RXA02571-downstream
TAGGTTTCTTTGGACCAAACCAC >RXA02578-upstream
GGCAAAAATGAGGAACAGCACGCCCGCAATAATGAGGACCGTTGCAGATCGCTTCATAAA
AACAGCCCACACCTTTCCGCTAAACTCGCATGTTGAAATA >RXA02578
ATGTCTACCCAATCATATGCACCCATCCGCCATCGCGGATTCATCAGCTCACTCGAGGGA
CTACGCGCAATCGCCTCCCTGGGAGTCTTGGCGACCCACGTTGCATTCCAAACCTCCGTC
GACCCCGCCAGCAACATCGGTGCAGTACTCGCGCGTTTCGACTTTTTCGTCGCCGTCTTC
TTCGCCCTCTCCGCCTTCGTTCTTTGGCGACGCCGCGCCGGGCAACCAGTGGGACTGTAC
TACCTCAAACGCCTAGCCCGCATCATGCCCGCATACTGGGCAACGGTCATTGCAGTCCTG
CTGTTTATTCCCACCGGCCCTGGTTAGCCAACCTGACGATGACCCAAATCTACTGGCCA
GACGGGCTCATGACAGGCCTCACCCACCTTTGGTCCCTGTGCGTGGAAGTGGCGTTTTAC
CTGGTGATGCCGCTTCTCGCGTGGGTGTTGGATAGGTTTGGTCGGCCGGTGCGCATCCTG
TTGATTGTTGGTGGGGCAGTGTTGAGTCTGGCGTGGCCGTGGATTCCCCTTGTGGAGCAT
GCGTTGGACGAGGGGTGGGCGAACATGCAGATCTGGCCACCCGCTTACGCTTGCTGGTTT
GCAGTCGGCATGATCGCCGCAGAAATTGAAGGAGTTCGATTCCCACGGGTTCCGAGCTTT
GTGTGGGTGGGTTTAGCTTTAGTGGTCGCTTGGATCGCGGGCCAAGAATGGTTCGGACCA
CTAGGTTTAGTGCACCCCAGCCCCTGGGAATTCAACTTAAGAGTCCTCGCGGGCACACTT
TTCGCTGTATTTCTGGTGGTTCCCTACGCGCTGGGTACGCCCTCTCGGCTTCTTGATTCC
AGTTGGATGAAAACGCTCGGCACCTGGTCGTATTCCATCTTCCTCTGGCACCTTCCCGTG
CTGACGATTGTGTTCCCACTGCTCGGGTTGCCTTTATTTAGTGGAAATTTCCTGTTGGTG
TTCATCGTGACGGTCTTGTTGACGATCCCAGTTGCCGCCATCAGCTACACCTTCATCGAA
GAGCCCATCAGCGGTGGACCCGGCGCGCCATTCAGGCTGGGGGTCGTTAGGATTCACCAT
TTTTCTGGGGGTAGGTCTGGAAAA >RXA02578-downstream
TGATGAATTGGCACCACGTCAAG >RXA02581
GTCCCTGTGCCGCTTTATGATCCAAACGAGCCAGGACACGCAGACCACCTCAACGCTGTT
TTCGCAGACAGCGAGCCAGTTGTCGTTCTGACCAACTCCAAGTCCGCAGGTGCCGTGCGC
AAGCACTTCTCCAGCCTTCCAGCTGCAGAACGCCCACGCATCCTCTCTGTAGATTCCTTG Attorney Docket No.: BGI-125CP

```
CCTGATTCTCTCGCGGATTCTTACGAGAACCCAATGCTGACCGAAGCCGGCCGCCGCCTG
GCTGCTCTGCGCCAGTCCGCGCCCATTGATCTGACCGCATTCCTGCAGTACACCTCCGGC
TCCACCCGAACCCCAGCTGGCGTTGTTCTGACCAACCGCTCCATCCTGACCAACGTCTTG
CAGATCTTCAGCGCCGCACAGCTGAAAACCCCACTGCGCCTGGTTTCATGGCTGCCACTG
CACCACGACATGGGCATTATCCTCGCGGCGTTTGTCACTATGCTTGGCCTGGACAACGAG
TTCATGAACCCACGCGATTTCGTGCAGCAGCCTTCCCGCTGGATTAAGCAGCTCAACCGT
CGCGAAAGCGACGTGGACGTTAACGTCTACACCGTGGTTCCTAACTTCGCCCTCGAGCTT
GCAGCACGCTACGCAAAGCCAGCAGAGGGAGAGACCCTGGATCTTTCCGCATTGGATGCC
ATCATTATCGGTTCCGAGCCAGTCACAGAAAACGCTCTGACCACCTTCCGTGAAGCTTTC
GAGCCTTACGGCCTGCCTGTTCAGACCCTGCGTCCTTCCTACGGTCTTGCAGAAGCATCC
CTGCTGGTCACCACCCCACAGACCGAAAACCGCCCACTGATCTCCTACTTCGACCGCGAG
GCCTTGGCCGAAAACCGCGTTGAGCTTGTAGAAAAGGGCAATAACAAGGCTGTTGCTTTC
GTCTCCAACGGCCAGGTTGCAGCCCCACAGCAGCTGGTCATCGTTGATTCCGAAACCGGA
ACCGAGCTGGCAGACGGCCAGATCGGCGAAATCTGGACCCACGGCGAAAACACTGCTGCA
GGTTACCTCGACCGCGAGGAAGACACCGCAGAAACCTTCCGCAACCGTCTGACCACCCGC
CTGGAAGAAAACTCCCGCGCAGAAGGTGCTGCCGACGACAACTACTGGATGGCCACCGGT
GACCTCGGCGTCATCGTAGACAACGAGCTCTACATCACCGGTCGTCTGAAGGACCTCATC
GTTGTCGCAGGCCGAAACCACTACCCACAGGACATCGAGTACACCGTCCAGGCTGCTTCC
GCACACATCCGTGCAGATTCCGTCGCAGCATTCGCAGTCCCAGGCGATGACATTGAAAAG
CTCATCATCCTGGCAGAACGCGACACCACTGCAAACGAAGCCGACGATGCAGCTGCTGAA
GAAGCAATCCGCTCCGCCGTTGGCACTGCACACGGTGTTGTTCCAGAAGAGATCCGTATC
CTCGCACCTGACGAGATCGCGCGTTCCTCCTCCGGAAAGATCGCACGCCGCGTCAACCAG
CGCAACTACATTCAGGAACAAGCTAAC

>RXA02581-downstream
TAGTTCTTTGCAGACACCGCAGG

>RXA02582-upstream
TGGATGTCTATTCTCCTCAGCCTCGTCTTGGTTGAGGCGGATAGTTTTAATATTTTTTA
AGTTTAAGTTGTAATCGAGCTGAAAGGCTGAGGCCTCAAT >RXA02582
ATGGAACAGAGCCAATCGTCGGATCAGAAGATGACCGTTGAACAGGTTCGCACCTGGCTC
CGTGATTGGGTTGTCCGCACCACGGGTATTCCGGTGGAGGAAGTTACGGATGACAAGGCA
ATGGAGACCTTTGGCCTTTCCTCTCGCGATGTTGTTGTGTTGTCTGGTGAGCTGGAAAAC
CTGCTGGACACCTCCTTGGATGCCACCATCGCTTATGAGTACCCAACGATCCGTAGTTTG
GCGCAGCGCCTTGTTGAGGGCGAGCCTCGTCGTGCACATACCCAGCGTGAATTGAATTTC
TCCGCGGTGAGCGATTCCCCAGGTTCCCACGATATTGCGGTTGTCGGTATGGCTGCGCGT
TACCCAGGCGCTGAGAGCCTGGAGGATATGTGGAAGCTACTCGTCGAGGGCCGTGACGGT
ATCTCGGATCTACCGATTGGCCGTTGGTCTGAGTATGCAGGCGATGAGGTTATGTCTCGG
AAGATGGAAGAGTTTTCTACCATCGGTGGCTACCTGTCAGATATCTCTAGCTTTGATGCG
GAGTTCTTTGGTCTGTCTCCGCTCGAGGCCGCCAACATGGATCCTCAGCAGCGTATTTTG
CTGGAGCTAACGTGGGAGGCTTTGGAGTACGCTCGCATCGCACCAAACACTTTGCGTGGC
GAAGCCGTGGGCGTGTTCATAGGTTCCTCCAACAACGATTACGGCATGATGATCGCTGCC
GATCCAGCAGAAGCACATCCTTATGCGCTGACTGGTACTTCTAGTGCGATTGTCGCTAAC
CGCATTAACTACGCTTTCGATTTCCGCGGTCCTTCCGTCAACGTGGATACCGCATGTTCT
TCTTCTCTGGTAGCGGTTCACCAGGCTGTCCGTGCGCTGCGTAATGCCGAAGCGGATCAC
GCTATCGCTGGTGGAGTGAACATTTTGGCATCTCCATTTGTCACAACTGCATTCGCTGAG
CTCGGTGTGATCAGCCCAACCGGCAAGATCCACGCATTCTCTGATGATGCCGATGGTTTC
GTGCGTTCCGACGGCGCCGGAGTCGTTGTGCTGAAGCGCGTGGATGACGCAATCCGCGAC
GGCGACAAGATCATCGGTGTGATCAAGGGTTCGCAGTGAACTCCGATGGTCACTCCAAC
GGACTGACCGCTCCAAACCCTGACGCACAGGTTGATGTGCTGCAGCGTGCATATGTTGAC
GCTCAGGTTGATCCCACCACCGTGGATTACGTTGAGGCTCACGGCACCGGCACCATCCTG
GGTGACCCCATTGAAGCAACTGCCCTGGGTGCTGTTTTGGGCTATGGCCGTGACGCATCC
ACCCCAACTCTTCTGGGCTCTGCAAAGTCCAACTTCGGCCACACTGAGTCAGCTGCGGGT
ATTGCAGGTGTCATCAAGGTGCTGCTTGCTTTGCAGAACAAGACTCTGCCACCAACCGTG
AACTTTGCAGGTCCAAACCGCTACATCGATTTCGATGCTGAGCGTTTGGAAGTTGTGGAA
GATCCACGTGAATGGCCGGAATACAACGGTCACGCAGTAGCTGGTGTGTCTGCGTTCGGG
TTCGGTGGAACCAACGCGCACGTGGTGATCTCTGAGTACAACGCAGAAGACTACGAAACC
CGTGCCCCGAAGGAGGCGTTGCTTCCTGACCAGCAGGTTGCCCTGCCGGTGTCTGGTCAC
CTGCCATCCAGGCGTCGACAAGCAGCTGCTGACTTGGCGGACTTCTTGGAGGGCCGCAAA
```

Appendix A, page 65

Atto___ Docket No.: BGI-125CP

```
GATTGCGACCTAACCCCAGTAGCCCGCGCGCTGGCAGGCCGCAATCATGGCCGCTCCCGC
GCAGTCGTGCTTGCAAGCACTATCGACGAAGCCGTAAAGCGCCTGCGCCAGGTCGCAGAA
GGCAAGGTCAGCGTCGGTATCTCCGCAGCTGATTCCCCAGCGGCCAACGGTCCTGTGTTT
GTGTACTCCGGTTTCGGATCCCAGCACCGCCTCATGATCAAGGAATTGTGCTCAATTTCG
CCACAGTTCCGCGAGCGCATCGAAGAGCTCGATGAAATGGTTAAGTTCGAGTCCGGCTGG
TCCATCATGAAACTTGTTTTGGATGATGAGCAAACTTACGACACCGAGACCGCGCAGGTT
GTGATCACCGCAATCCAGATCGCACTGACTGACCTGTTGGCAAGCTTCGGTGTAAAGCCA
GCTGCCGTCATGGGCATGTCGATGGGTGAGATCGCTGCCGCTTACGCTGCCGGTGGACTC
AGCGACCGCGATACCATGCTCATTGCCAGCCACCGTTCCCGCCTAATGGGCGAGGGCGAG
AAGTCCCTGGCTGAGGATCAGCTGGGTGCCATGGCTGTGGTGGAATTCGCCGCTGCGGAC
CTGGATAAGTTCATCGAAGAAAACCCTGAGTACAAGGGCATTGAGCCTGCTGTTTATGCA
GGCCCAGGCATGACTACCGTGGGTGGACCTCGCGACGCCGTGGTTCAGTTCGTAGAGAAG
CTGGAATCTGAAGACAAGTTTGCCCGCCTGCTCAACGTCAAGGGCGCTGGCCACACCTCT
GCTGTGGAACCACTTCTTGGTGAGCTCGCTGGCGAAATCGCTGGCATCGAGCCACTTCCG
CTGCAGATCCCGTTGTTCAGCTCTGTCGATCAGGGTGTTACCTACCCAGTTGGAGCAGTG
GTCCACGACGCCGATTACATGCTCCGCTGTACCCGCCAGTCCGTGTACTTCCAGGACTCC
ACCGAAGCTGCATTCGCTGCAGGCCACAACACCTTGGTGGAAATTTCCCCGAACCCAGTT
GCACTCATGGGCATGATGAACACCGCGTTCACCGTGGGCAAGCCTGATGCACAGCTGCTG
TTCAGCCTGAAGCGAAAAGTCCCAGAGGCAGAATCCCTCCGCGACCTTCTGGCGAAGCTG
TACGTCAACGGCGCAAACGTTGATTTCTCCGCGCTGTACGGCGAAGGTGAAACCATCGAT
CCGCCACACATCACCTGGAAGCACCAGCGCTTCTGGACTTCCGCACGCCCATCCTCTGGC
GCATCCCTGGATCTGCCGGGCTTCCGCGTGAATCTGCCAAACAACACTGTGGCGTTTTCC
ACCGCAGCCGAACTGGCACCATCCGCAGTGGCAATCATGGAAGCAGCCGCCATGGCTGTC
ACCCCAGGTTCCTCCGTCGACGCAGTGGACGAGCGCGACATGCTGCCACCAAGCGGCGAA
ATCACCACCATCGTGACTCGCTCCTTGGGCGGTTTGAGCCTGTCCGTATACAAGATTGAG
GGAACCACCAGCACTCTTGTCGCCGAAGGTTTCGCAGCCAACCCAGGATTCGCCGCAGCA
TCTTCCTTCGACGGTCCAGGCTACGACGGATTCAACACCGATTACAGCGACCAGCCAGAC
CCTCGCTCCGACCTGCCTTTGGACATCGAAGCAGTCCGCTGGGACCCAGCGACCGAAACC
GTCGAAGAGCGCATGCGCGCCATCGTCTCCGAAGCAATGGGCTACGACGTGGATGACCTC
CCACGCGAACTCCCACTGATTGACCTCGGCCTCGACTCCCTCATGGGCATGCGCATCAAA
AACCGCATCGAAAATGACTTCCAGATCCCACCACTCCAGGTCCAAGCGCTCCGCGATGCA
TCCGTCGCTGACGTGGTAATCATGGTGGAAAACATGGTCGCTGGCCGCTCCTCTGAGACG
CTTGTCGACGCCACCCCGCAGGTGCCAGCTGAGGCAGCAGGGGAGGCTCAAGCTGCTGAG
TCTTCTGCTTCGGGCGAGGACGTGCAGGGCGTTGGCGTTGCACCGCGAGATGCGTCGGAA
CGCATGGTCTTTGGTACTTGGGCAGGCCTGACTGGCGCTGCGGCAGCTGGCGTGACCAGC
AAGTTGCCACAGATCGATGTCGATACTGCAACCGCAATTGCCGAGCGCCTCACCGAGCGT
TCCGGAATTGAAATCAGCACTGAACAGGTGTTGGCTGCAGAAACCCTCGAACCACTGTCT
GACCTGGTGCGTGAAGGCCTCGAAACTGAAGTTCAGGGCAACATTCGTGTGCTGCGTGGA
CGTGCAGAAGGCTCCACCAAGCCTGCAGTGTTCATGTTCCACCCAGCTGGCGGTTCTTCC
GTGGTCTACCAACCACTAATGCGTCGTCTGCCTGAAGATGTCCCTGTCTATGGCGTTGAG
CGTCTGGAAGGCGATCTCGCTGACCGCGCGGCAGCATATGTTGATGACATCAAGAAGTAC
TCCGATGGCTTCCCAGTAGTTTTGGGTGGCTGGAGCTTCGCCGGTGCCGTTGCCTTCGAG
GTTGCCCACCAACTGGTTGGCTCCGATGTTGAGGTAGCTACCGTGGCGTTGCTGGATACT
GTGCAGCCTTCAAACCCAGCACCAGATACCGCTGAGGAAACTCGTGCACGCTGGACTCGC
TACGCGGACTTCGCCAAGAAGACCTACGGCCTTGATTTCGAGGTACCTTTTGAAATCTTG
GACACCATCGGTGAAGACGGAATGCTGTCCATGATGACCGACTTCCTGGCCAACACCGAC
GCCTCCGAGCACGATTGTCCGCAGGTGTGCTTGAACACCAGCGCGCTTCTTTTGTGGAC
AACCGCATCCTGGCTAAACTTAATTTTGCAGACTGGGCCAACGTTGAAGCCCCTGTCATC
CTGTTCCGCGCGGAACGCATGCATGATGGAGCTATCGAACTTGAACCAAACTATGCCAAG
ATTGATCAAGATGGAGGATGGTCCGGAATTGTCAACGATTTGGAAATTGTTCAGCTGAAT
GGTGACCACCTGGCAGTTGTCGATGAACCAGAAATCGGCACAGTCGGAGCTCATTTGAGT
CGCCGCATTGATGAGATTTCTCGGAAGAAT
```

>RXA02582-downstream
TAGTAACGGAGAGCTGACGGAAG

>RXA02583-upstream
CAGTTGTCGATGAACCAGAAATCGGCACAGTCGGAGCTCATTTGAGTCGCCGCATTGATG
AGATTTCTCGGAAGAATTAGTAACGGAGAGCTGACGGAAG

>RXA02583

Att     Docket No.: BGI-125CP

```
TTGAGTAACACCACTACTGCAGAGAAGCTAGCGGATCTGCGCGCACGCCTGGAGATTGCC
AAAGACCCAGGTAGTGAACGCGCACGTAAAAAGCGCGACGAGGAAGGCCGAACCACCCCT
CGTCAGCGTATTGATGCTCTGCTTGATGCCGGATCCTTTGTGGAGATCGGCGCACTAGGC
CGTACCCCGGATGAACCCGATGCGCCTTACTCTGACGGTGTGGTGACTGGTTATGGTCGC
ATCGATGGTCGCCCAGTGGCCATCTACGCCCATGACAAGACCGTTTACGGTGGTTCCGTG
GGCATGACTTTCGGACGTAAAGTCAGCGAAGTCATGGACATGGCTATCCGCATTGGTTGC
CCAGTTATCGGTATTCAGGATTCCGGCGGAGCCCGCATTCAGGATGCGGTGACCTCCTTG
GCGATGTACTCAGAGATCGCGCGTCGTCAGCTTCCGCTGTCTGGCCGCAGCCCTCAGATT
TCCATCATGCTGGGTAAATCGGCAGGTGGCGCAGTGTATGCACCTGTGACCACTGACTTT
GTTATCGGCGTTGATGGTGAAACAGAAATGTATGTCACCGGCCCAGCCGTGATCAAGGAA
GTCACCGGCGAGCAGATCACTTCCGCAGACCTCGGTGGCGGTGCGCAGCAGATGCAAAAC
GGCAACATTTCCTATTTGGCGTCCTCTGAAGAAGAGGCCCTGAATATGGTCAAGGATTTG
CTCGACTTCCTGCCTTTGACCTGCAATGATCCAGCCCCTGTGTTTGCAGCACCAACGGAT
GAAGAGATCGCCTACGACGAAGCTCTGAACTCGTTCATGCCTGACGACACTAACCAGGGC
TACGACATGCATGACCTGCTGGACAAGCTTTTCGACGACGCCAACCTGCTGGAAATCCAA
GAGGAGTACGCCCCCAACCTGATCACTACCTTCGCCCGCGTTGATGGCAAGGCAGTCGGT
GTGGTGGCCAACCAACCAATGGATAAGGCAGGCTGCATCGACGCTGACGCCGCCGACAAG
GGCGCCCGCTTCATCCGTATCTGCGACGCCTACAACATCCCGATCATCTTCGTCGTGGAC
ACCCCTGGCTACCTGCCTGGCGTGGACCAAGAGAAGGTCGGTTTGATTCACCGTGGCGCA
AAGCTAGCCTTCGCAGTGGTGGAATCGACCGTCCCTAAGATTTCCTTGATCGTGCGCAAG
GCCTACGGCGGAGCATATGCCGTGATGGGTTCCAAGAACCTCACCGGTGACCTCAACTTC
GCATGGCCAACCGCACAGATCGCCGTGATGGGCGCAGCCGCAGCTGTCGTGATGATCCAG
GGCAAGCAGCTCGAAGCCGCCCACCTGAGCAGCGTGAATACATGAAGAAACTGTTCATG
GACTTCTACGATGAGAACATGACCAGCCCATATGTGGCCGCCGAGCGTGGTTACATCGAC
GCCATGATCGAACCTGCAGAGACCCGTTTGGTGCTTCGCCGAGCAGTCCGCCAGCTGGAA
ACCAAGGCTGTGCGAGACCTCGACAAGAAGCACACGATCATGCCGATG

>RXA02583-downstream
TAACGTCCAAAGAATTATCCAGA

>RXA02599-upstream
GATCAAGCATCATACGATGTCGGAGATTGTGGCGGGCGTTGTTACAGGAGCAGTTGCAAC
CGGCATTTGTTATGCACTCCTACTTGCGTAAAGGAGAATT >RXA02599
ATGGATCAGCTAATCCTCGACGCATTTATCGGCTTGAGAGTGACTTGGCTGAGTCCGGTG
ATTATTTTGTTCACCCAGCTCACCGGGCCAACACTGATGTTTGTGTATGCGCTTGTGTGG
GGCTTGTTGCGCAAGAGCGCCACTGCCCCGATCGCGGTGGGGCTGGCTAATCTGATCAGT
CATTTTCTCAAGAGGGCGTTTGAACGGCCTCGACCAAATACAGCAGAGCACTTGGTTGTA
GAAACTAACTTTTCATTCCCTTCTGGTCATGCTGTGGGCGCTGCAGCATGTGCCGTGGCA
GTGGGGTACTCCGTGAACCGGTGGTGGAAACTCACGCTGTGGGTAATCGCGCTGCTTGTG
GGGCTGTCTCGGTTGTATGTCGGTGTGCATTGGCCCAGCGATGTGCTTGCCGGCTGGGCC
ATCGGTGCGTTGACTTCAGTGGTGGTGTTACCAGCTGGAACCTCCTCCAGCGCCGC >RXA02599-downstream
TGAAACCACTGCTGAAAGTGGTA >RXA02618-upstream
CGAAACCAGAAACACCCAGCGGCTCCTCGTCGAAAAGCGAATCTTTGAACTAGAAGCCCA
GGCACGTTGGCTCGACCGAATTGAAGCATTGGAGCAGTAA >RXA02618
ATGACAAACACGCCTTTCCCCCTTGAACTTCAAAACATCTCCTGCGCCTTCGGAGAAGGC
CCACGCCACGTCTCCGCGCTCAACAACGTCTCGCTGGCAGTCAATCCGGCGAACTCGTT
GCCATCATGGGCCCGTCCGGCTCAGGAAAATCCACCTTGCTCAACGTCGCCGGCCTCCTG
CAGCGCGCAACCTCTGGCCATGTGCTTATCGACGGTGCCAGCGCCTCAGACCTCAACGCC
AAACGCGCAGCTGAAACCAGGCGTCGCCACATCGGAGTTATTTTCCAAAACTACAACCTG
GTCCCCACCCTCACCGTCGGAGAAAACATCGGTCTGCCCCTAGAACTCGACGGCAAAACC
GACCGCCAGGCAGTAGCAATCGCACTCGCGGAAGTCGGCCTCAAGGGCTCTACGACCGCT
TTTCCCGAGAGATCTCTG
```

Appendix A, page 67

Attorney Docket No.: BGI-125CP

>RXA02634-upstream
CAACGCGAAGGCTTAGTTGTTTATTACCGGCTCACCTACCCGGAGGTCGCAGACTTTCTT
AAGGTGAGCCGCTCACTATTAAAGAGGATGGCTGGCGAAG >RXA02634
ATGCGTGACCTTTTACCCTCTAGAGACGACTATCAGCTACTCCGCTTCTCCTGGAAGATG
GACATTGCTGCTGGCGTCACCGTGGGCATTGTTGCCCTCCCCCTCGCTCTCGCCTTTGGT
GTGAGTTCTGGAGTCGGAGCCGAGGCAGGATTAGTGACTGCGATTATTGCTGGCCTGGTT
GCAGCAATCTTCGGCGGTTCCAATGTGCAGGTTTCAGGACCAACAGGAGCGATGGTGGTT
GTTCTCGCTCCAATCGTCGCCCAATATGGTGTCGGTGCGGTTGCATTACTCAGCCTGATG
GCTGGAGTTATCGTCCTTGTCGCCGGAGTGCTTCGATTAGGCCGAACGGTGAGTTTCATT
CCGTGGCCGGTCATCGAAGGATTTACGGCAGGCATCGGTGTGATTATTTTCCTGCAACAG
GTGCCAGCTGCGTTTGGTTATTCGGGCCATTTGCCCACCAATGCGCTCCTCGCTGCGATT
CACACTGTTTCACACGCCACGAAGGACGCAATTCTACCTCTCTTAATTATTATCGTCACC
GCTGCGATCATGATTGTGTTGGGAAAGATCGCCCCAAAGCTCCCTGCCAGCTTCATTGCC
ATTTTGGTGGTGTCCATTGGCGTGGCTCTGCTCAAGCTTCCCGTTGAGTTGATCGGTGAG
CTCCCCAATTCCCTTCCTGCCCCTCACCTGCCTGATGTGAACCTGGAGATGTTCACGAGT
TTGCTGGGGCCAGCTTTTGCTGTCGCCGCGCTCGCTGCTATTGAGTCTCTCCTTTCCGCT
CGTGTGGCAGCCTCCATGGCCGATACGGGTCCTTATAATGCTGACCGCGAATTGGTCGGT
CAGGGGTTGGCGTCGATAAGCGCTGGCTTTTTTGGCGGCATGCCGGCAACTGGCGCAATC
GCGCGTACGGCGGTCAATGTGCGCTCCGGCGGGCGTACCCGTATAGCGTCGATTATTCAC
GCGCTTGTGCTGCTCGGCGTTGTGTATGTGGCGGCGAATATCGTTGCGGTCATTCCGCTC
GCCGCACTGTCGGGCGTGCTCATGGTCACCGCGAGCCGCATGGTGTCCATTGAAGTGATC
TCGCGCGTCATGCGCTCCACTCGCTCTGATGCGATCGTTTTTGTCATCACCGCGATCGTC
ACCATCAGCGTCGACCTCGTCATTGCGGTCGGCATCGGCATTGCCGTCGCGACGTTCTTC
ATGCTGCGACGCATGAGCATGAACGCCGGCGTCTTCCGGGAAACCTTGCCCGAACCGGCC
ACGCTTAACGACGAAAAGATCGGCCTTTTCCGTATCGAGGGCGCATTGTTCTTTGGCGCA
GCTGAACGTCTTTCGCAGCAAATCCTTGATTATGAGGACCTCGAAGTGGTGATCCTGCGC
CTGTCACACATCCAAATGATCGACGCCACCGGCGCCCACCAGCTCACCGAGCTTGTCAAT
GCGCTGGAAAGAAAAAATGTCACTGTATTAATTAAGGGCGTCCGGAAAGAACACATTCAC
GTTCTCGGCGTCCTCGGAGCGATCAGATCACTGCGGCATGAGAACCACCTCTTCGATGAC
CTTGCCCCAGCGGTTGAACATGCCCGAAAACACGTTAAGATCGACAACAGT >RXA02634-downstream
TAAGGCTTCCGGGGCGATCTAAA >RXA02638-upstream
ATGAAGA >RXA02638
ATGGCGCGGAAGCGTCTTAACGCCGGCAGCCTCGTCGGTATCTTCCCTGAGGCGACGGTG
TCACGGTCCTTTGAAATCAAGGAACTAAAAACTGGCGCCGTCCGCATCGCCGACAGCGCT
AACGTTCCGCTGCTGCCACTTATTATTTGGGGCGGCCAGCGCATCATCACCAAAGACATC
GAGCGCGACTTCGGCCGCTCCCACATCCCCGTATTCATCAGCGTGGGTGAACCCGTCGAC
GCCAGCGGCGATCCCGACGAAGCAACGGAACGCCTCTACGAGGCTATGAAAAAGCTTCTC
GACGAAACCCGCACCGCCTACGAACAAAAGTATGGCCCATTCGAAGGTGGAGAATTGTGG
CGCCCGAAATCCCTCGGCGGCGGCGCCCCAACGTTGGAGCAGGCGAAATGTTGGAAATC
GCCGAACGGGAACGTCGACAAGCAAAACGCGCGGCAAAGGTCGCCAAGAAACGCACCACC
TTTATAAGGAAAATCTTTAAAAAA >RXA02638-downstream
TGATTGCACTGGGTTCAGCGCCC >RXA02659
TTCGGCAACGACCCAGACCTCCTCATGCGCTGGTGGTACGCCGGCGACGTCTGGACCGAC
TCCCGCATGCACTGGAAGGGCAGCGAATCCTACGACCAGGTACAAAACCTCCTGGAAGAA
GGCATCCGCGCTACCGACAAGGCAGAACAGCCAAGACATCTGGAACCGCCACCTTCGATGTC
ATCTCCGACAATGTTCCCCTCTACCCGCTGTTCCACCGCAAGGTCCCAACCGCATGGAAC
TCCAACGCCCTCGTCGACTTCAAGCCAATCTCACTCACCGGCTTGAACTTCTCAGGTGTT
GCAACTACTGAA Appendix A, page 68

Attorney Docket No.: BGI-125CP

>RXA02659-downstream
TAACAACCCCAGTGGCTTTCAAA

>RXA02676-upstream
AACCATTGGGTATTAAGAAATTTGTGGCTTAGATCTCAATTTCTGTATAGTTTGATCATA
CTAATTCATCCACTTCCAAATTTTCACGAAGGATCACCCC >RXA02676
ATGGACACCTGGGAACAAACCCTTGGAACAGGGCCACTGCTAGGCATTGCAGCCGGCGCC
ATTGCCCTCATCTTGGTTCTCGTCATCGTTTTTAAACTCCATGCTTTTCTCACCCTAATA
CTGGTTTCAATTGTTACCGCACTTGCTGCCGGCATTCCCGTCACCGCAGTAGTGGACACT
CTCCTTGACGGTTTTGGTAAAACACTCGCCTCGGTCGCCCTATTGGTAGGCCTGGGTGCC
ATGCTTGGTCGATTGGTTGAAACATCCGGTGGCGCAAAATCTCTAGCCGACACTATGGTG
CGAATCTTCGGTGAAAAACGAGCAGCTTTCGCACTCGGTGTCGCATCGCTGATCATGGGA
TTCCCTATCTTCTTCGATGCTGGCCTCGTGGTCATGCTCCCAGTGATCTTCGCAGTAGCT
CGACGCCTCAACGGCTCCGTCCTTACTTTTGGTATCCCTGCAGCTGGCGCCTTCTCTGTC
ATGCACGTGTTCGTCCCACCTCACCCAGGCCCAATTGCAGCCTCTGAATTCTTCGGCGCA
CAAGTTGGATACGTACTAATCGCTGGCATCATCGTTGCACTACCCACCTGGTATTTAACC
GGTTACCTGCTAGGTAAGTTCTTAGGCCGAAAGTTCCCCCTTCCCGTACCCGATCTACTC
AGTGGTGGAGCACAGGAAGATGATCAGCCTCAGAACCCAGCTAACGCAGTGTCGATCATT
GTCATTTTGCTCATTCCTATGCTCCTTATTTTTGGCAATACCGGAACATCAATGGCAGTT
TCCGCCGGCCTCCTAGATGCAGAATCCACCATGGTGAAAATTCTAGGATTCCTCGGCGAA
ACACCAGTGGCACTGCTCATTACCTTGATCATTGCCCTGTTCTTCCTAGGCAACCGACGT
GGCATTAATGGTTCTGCTCTAGAGAAAACCATCGAAGGCGCACTCGGCCCAATCTGTTCA
GTCGTATTAATCACTGGCGCCGGTGGCATGTTCGGTGGAGTGCTACGCACGTCTGGAATT
GGAGGAGCGCTTGCAGACTCCATGGCAGATCTAGGACTTCCAGTTATCGCAGGTTGTTTC
ATCGTGGCAGCCGTCCTTCGTGTCGCGCAGGGTTCTGCCACCGTTGCGCTAACCACCGCC
GCAGCACTCATGGCACCTGCTGTTGCCGCTGCTGACTTTAACGAATTCCAGCTTGCTGCC
ATCGTTATTTCCACTGCCGCTGGTTCTGTTATTGCCAGCCACGTCAACGACTCCGGATTC
TGGCTCGTTGGTCGACTCATGAACGCCGACGTACCCACCACGCTAAAAACTTGGACCGTA
AACCAAACCTGCATTGCGATTGTGGGATTTGTGATGGCCTATGCAATGTTCGGATTGGCA
TCGCTTGCA >RXA02676-downstream
TAGTCCGCTGACCCCATTGATTC >RXA02677-upstream
TTAGTGCAGTGTATTTATTTCCGTTCACGCTGCGGGGCTGGTGGTTTGGAGGGATACTAG
AGTCGATAGCAGGTATATAAAGGCCAGGAGAGATGGGTTC >RXA02677
ATGAAAGTCATCGCGCACCGAGGTTTATCGTCTCGCTTTCCCGAATTAACAGAGTCTGCG
TTTCGGGCGGCTCTAGAGCTACCGATTCATGGAATTGAAACTGATGTCCGGCTGACTAAA
TGTGGCGAAGTGGTTAACGTCCATGACCCCATTGTGGATCGCGTGTCGAATGGTCGCGGT
CGGGTGTCGCGTTTGGACTTGGAATCCTTGCTGAGCTTGAACTTTGGAACCAAAGAAACC
CCAGAAAAAGTGCTTACTTTAAACAATCTATTAGATATTTTTGAGGATTATCCAGATAAG
CACCTTTATATAGAAACCAAGCACCCAATGCGCTACGCGGTCATGCTGGAAGAAGAAATC
ACAAAAATCTTAAAATATCGTGGGCTGACGGAAGACCCACGCATCCACATCATTTCTTTT
GCACTTCCCGCGATGTATCGCATGGCTCGCCTTGCTCCACAGCTTGATCGCATTCATCTG
CGCAGGTCGTGGGAGCGTTGGGGTAATCCGCGCGATGTGCGCTGCGGTGTACCCACCGGT
TTGGGGTTGTCGCTGGAGCGGGCGAAGATGGATCCAAGGATGATTGGGGCGAAAGGGTTA
CCCACCTATCTTTTCACCGTCGATAAGCAAAAAGACATGCGTGGGCGCGCGAACAGGGC
GTCGACATGCTCGCCACCAATTATCCGGACCGTGCGGCGGAGCTTTTGAACGCACATCCC
AAGCCCGCCATGTACGCTAATGCGCATGGCAAAGAAGAC >RXA02677-downstream
TAAGAAGAATGAACAGCTGCCGG >RXA02691-upstream
CTTAGGGCTTATCTGTTTTCCAGCCTTGCTTTTTACTAGGCGCTCCTGTCCCGCTTCAGT
CACCAAAACCACACCCCTGGTTATGACCAGATCGGCTAAA Appendix A, page 69

>RXA02691
ATGAACACCATGCCTGACCAACCGCTCAACCAGGACGGATTCCCTACCGCATCCAAAGGG
GTGGAACCCGACAACCTCCCCGACCGCGTTCTCGTGGACGGCCTTAAACCAAAGCATCAG
CAGCTTCGTGAAATTTTGGAGGAAATCTGCACCACCCAGCTTCAGCCTGGGGACATGCTG
CCTGGTGAGCGCATCCTGGAAGAAAAGTATGGCGTCAGCCGAATTACGGTTCGTCGGGCG
ATTGGTGATCTGGTCGCGTCCGGCAGGTTGAAGCGAGCTCGCGGCAAAGGTACCTTCGTG
GCCCACTCGCCGTTGATTTCCCGCCTGCATTTGGCCTCGTTTTCCGCAGAGATGGCCGCC
CAGAAGCTATCGGCTACCAGCAGGATTTTGAGTTCTTCCCGCGGTCCCGCCCCAGATGAT
ATTGCTGATTTCTTTGGTACCGATCGCGCGGCCCAGCACATCACGTTGCGCCGCCTGCGC
TTTGGAAATGGTCGACCCTATGCCATTGACAACGGTTGGTACAACTCCGAATTCGCACCT
GACCTGCTGGAAAATGATGTGTACAACTCCGTGTACTCCATCCTGGACCGCGTCTATGGC
GTCCCCGTCACCCAGGCCGAGCAAACGGTCACCGCCGTAGCAGCCGACGAAGACACCGCA
CGGCTTCTGGACGTCACCCCCGGCGCCCCACTCCTTCGTATCCTTCGACAGTCACTTTCT
GGCGATAAGCCCGTGGAATGGTGCGTTTCCTTGTACCGAACCGACCGATATTCTTTAAAA
ACATTGGTTACACGCTCCGAAGATCTC

>RXA02691-downstream
TGACGTGAACCCATTTTGGTGGC

>RXA02718-upstream
TCCACCAAAATTCAGCCCGCATCCCCCTATTCGATTGAAGGACGTCTCCTTGAGCAGTTT
CGATGCCCATGACCTTGACCTCGACAAATTTCCGGAGGTC >RXA02718
GTGCGAGATCGTTTGACGCAGTTCCTCGATGCTCAAGAGCTAACAATTGCTGATATCGGC
GCTCCTGTCACAGATGCTGTGGCCCATCTTCGCAGTTTCGTGCTCAATGGAGGAAAGCGA
ATCCGTCCTCTTTATGCGTGGGCTGGTTTCCTGGCGGCGCAAGGCCATAAGAATTCTTCT
GAAAAACTTGAGTCCGTCCTTGACGCCGCAGCGAGTCTCGAATTCATCCAGGCTTGTGCC
TTGATTCATGACGATATTATCGATTCTTCTGATACCCGGCGCGGAGCCCCCACAGTTCAC
CGGGCTGTGGAAGCTGATCACCGCGCCAATAATTTCGAAGGCGATCCCGAGCACTTTGGC
GTTTCAGTCTCGATTTTGGCTGGCGATATGGCATTGGTGTGGGCAGAAGACATGCTGCAG
GATTCCGGTTTGAGTGCAGAGGCATTGGCCCGCACGAGGGATGCTTGGCGTGGCATGCGT
ACTGAGGTTATTGGCGGCCAGCTGCTTGATATTTATCTAGAGTCGCACGCCAACGAGTCG
GTGGAGCTTGCGGATTCTGTCAACCGCTTCAAAACGGCCGCTTACACGATTGCGCGCCCA
TTGCACCTGGGCGCCTCCATTGCTGGCGGTTCGCCGCAGCTTATCGACGCGCTCCTCCAC
TACGGCCACGACATCGGCATTGCATTCCAGTTGAGGGATGATCTGCTTGGTGTGTTTGGG
GATCCCGCTATCACCGGCAAACCAGCTGGAGACGATATCCGTGAAGGCAAGCGCACTGTT
CTTCTTGCGCTCGCTCTACAACGCGCTGATAAGCAATCTCCTGAAGCTGCAACGGCCATT
CGCGCAGGTGTTGGAAAGGTGACTTCACCAGAAGATATTGCTGTCATTACGAGCATATT
CGAGCTACTGGTGCTGAAGAAGAAGTTGAGCAGCGAATTTCCCAGCTGACTGAATCCGGT
TTGGCTCACCTCGATGATGTAGACATCCCCGATGAGGTGCGCGCACAGTTGCGGGCACTG
GCTATCCGCTCAACCGAACGTCGGATG >RXA02718-downstream
TAGTAGACGCGTATGACACTTTT >RXA02749-upstream
CAACCTAGACTTCGGTAAGAAGTAACTTTGCTTTAGTTGGTCGGCGCATCACTTTCCCTA
AGCGATGCGCCGATTACTTGTTTTTGCTACAAATTTAACT >RXA02749
ATGTCACCCATCCTAAAAGTGCGGGACCTCGTCAAACGCTATGGCGACACCGTTGCGGTT
GACGGTTTAAATTTTGATGTTTCACAAGGGGAAATTTTTGCCTTTCTAGGGGAGAACGGC
GCAGGAAAAACAACCACGATTTCATGCCTGATTGGCATTGATCAAGCCACCTCTGGGGAG
ATCGAACTGCAGGGTGGCCAAGTAGATTCTGAAAAACTTGGAGTGGTGTTTCAACAATCC
GTCTTAGACCCTTTGCTGAGTGCCAAAGAAAACTTGGAAACACGCGGACAGCTGTACCCA
GGGGTGGGGAAGCAGCGGGTTGCACAGCTCATTGAGCAAATCGGGATGGAAGGGTTTGCG
GACCGCCGATACGGAGTGTTGTCGGGCGGTGAAAAACGTCGCACCGACATCGCACGAGCT
TTACTGCACAGCCCAGACATTCTTTTTCTTGATGAACCCACAGCAGGCCTCGACCCCAGA
TCACGACGCCAAGTTTGGGACACCATCAATTCCCTGCGTAACGATGTGGGCCTCACTGTC Appendix A, page 70

Att Docket No.: BGI-125CP

```
TTTTTGACCACTCACTACATGGAAGAAACAGAACTGGCTGATTCAGTTCTAATCATTGAC
CGTGGCAAAGAGGTCGCATCAGGAACCCCGATGGAACTGCGCGCCCGTTACACCACAACA
GAATTGACTCTTAGAACAAACGACCCTACTCATTCGGGTAAAGAGTTGGCCCACTTGAGC
CCAGAAATCGACGGTGACCGACTGCGGATCAAGTTGGAAAATGGGCTCGAAGCTGCGCGC
CTGGCAACAGAACTAGATGGGGTTCTCGACGTAGAGATCCGCCACGGTTCCATGGACGAT
GTATTTCTAGCAGTTACAGCTGAACGGAAACGATCA

>RXA02749-downstream
TGATTACAGTTCTGACACGCAGA

>RXA02762-upstream
TTCCCAGTCGGCGATCCTCTTCGCCCCTACGTTATCTTGACTCTGGTTGTGGTCTTCGTG
GGATCCATGCAGACCTTCCTCAACGGTAGCTACCTGGGTT >RXA02762
ATGCTCTCTGAGCTCTTCCCGCTGGCAATGCGCGGTTTCGCAATCGGTATCTCAGTGTTC
TTCCTCTGGATCGCAAACGCGTTCCTCGGATTGTTCTTCCCAACCATCATGGAAGCAGTA
GGACTAACCGGAACCTTCTTCATGTTCGCCGGAATCGGTGTGGTTGCCTTGATCTTCATC
TACACCCAGGTTCCTGAAACTCGTGGACGTACCTTGGAGGAGATTGATGAGGATGTTACT
TCCGGTGTCATTTTCAACAAGGACATCCGAAAAGGAAAGGTGCAC >RXA02762-downstream
TAAAAACCCAGACACTGCATAGA >RXA02767-upstream
GGGAAAACGTTTCCTCGCCGCCCACAGAATCATAAAAATTTTCTGAGGTTGTCATGGGTA
CCAGTCTAAGCCCTGGCCTTACGCCAGTAAGGTGTTACCC >RXA02767
ATGCGCGAACTAGCACTCAACATGGCCGGCGTCACCGTGCGGCGCGGCGAGAAATTGCTT
CTCGACGATATCTCCCTCTCAATTCCGCAAGGGTCGCACTGGGCCGTACTTGGTCCAAAT
GGCGCCGGTAAAACCACCATGCTGAAGATCGCAGCCACCTTGCTGTACCCATCGGAAGGC
ACCGTGGACATCCTGGGGCATCGCTTTGGTCGGGTGGATACTCGTGAGCTGCGGAAAACA
ATCGGCCTGGTGGACCCGAAGCAAAGATTTACCAACCTGCCGGCCCACGAAATTGTGCTG
TCGGGGTTAACCGCCTCCAACGGGTTGTTGCCACGGTGGTCGGCTTCGGCTTCGGAGTTG
GAGCGGTGCGCTTTGATGTTGGAGTTGGTGGGCATGACAGCGCGTGCCGATCGTTACTGG
GCCGATATGAGCCAGGGCGAAAAAGCCCGCACCCTGATTGCTCGTGCGCTGATTATCTCA
CCGACCCTACTGCTGCTTGATGAACCCACCACCGGCCTTGACCTGCCCGGACGTGAAACT
TTGCTCAGTGTGATTGATGGTTTGCGAGCCGCTCTTCCTGGTCTGACGACAGTGATGATC
ACCCACCACGTCGAAGAGATCGCCGCCTCCACGACAGATATCCTCATGATCAAGGACGCC
CGCATACTGGCTTCGGGGACTGTTTCAGAAGTGATGACTCCTGAAAATTTGGGCGCGCTG
TATGACATGTCGGTGTCGTTGGAAACTGTGCGCAGCCGGTGGTTCGCGTTCGATGCTCTG
CAT >RXA02767-downstream
TAAAAGGGGCTAGTTTTACACAA >RXA02792-upstream
AGAACAAAGTGCTGCCCATACTCATGAACTTTGCCGAACCCCCAACCCCGCTGGCCGTCG
ATGGCCTAGAAAAAATCATCGACTTTGTGGAAACCCACCC >RXA02792
ATGATCGAGGCCACACACCTACGCCACAGTTTTGGCGACAACATCGTCATCGATGACGTC
ACCCTCCATCTACCTGCACACGGCACCGTCAGCTTGGTCGGCCCCAACGGCAGTGGCAAA
ACCACCCTGCTGCGTGCACTATACGGAGCACTGCAACCAAATGAAGGGCACATCCACGTA
GATGGCGTTCCACTAATAAGCTTGCACCGCAAAGACATCGCAAAAACCATGGCCGTAGTC
ATCCAAGAACATGACTCCGACCTCCCCATGACCGTCGCTGACCTGGTCTTACTAGGCAGA
CTCCCCCCACCAAAAGATGTTTGCCGGCAACTCTCAAGCTGATCAGTTACTCGTTAAGGAA
GCACTCACCCGAGTCGGCGCCATTCACCTGGCCGACCGACAATTCGGCGCACTTTCAGGC
GGTGAACGCCAACGCGTCCTCATCGCACGAGCACTCGTACAAAACGCCACACACATTCTG
CTCGACGAACCCACCAACCACCTCGACATCCGCTACCAGCACGAAGTCCTTCACCTCGTC
```

Appendix A, page 71

CGCGAACTCAGCTCAAGTTCCATCATCGTCCTCCACGACCTCAACCTCGCAGGTGCCTAC
AGCGACCACATCATCCTCCTTGACCAAGGACGTGTGGTTACTCAAGGAACGCCCTCAGAG
GTATTGACCCCAGAGCATTTGGAACCTGTGTATGGCGTTCGTGTTGAGCGCTTTGACCTA
GGCGATGAAGTCCACCTTCGGTTCAAGCGTCAC

>RXA02792-downstream
TAGGAGTTTTGTTGAGGAGGTGG

>RXA02794-upstream
TGAACTCAGGTGCCAGTTGCGGTGCGGCCGCTGCCTTACTGTTCGGAGTGGGCGCTGGAT
TTGGCGATTACGCCCTCCAAGCAGCGCGTTTCTCGGCGCA >RXA02794
ATGGCAGCTTCCGGATTGATCTTCTTCGTGGCGCGCGCAGCGGGGCGCATCTCCTCGACC
CGCTTGTTGATGTCCGGCGTAGCGATCGGATACATGCTCTCTGCGGCAACAAGCTTTCTC
ATCTTCTCCTCCGACTCCGCCGAAGGCAGCCGCTCCGTGTTGTTCTGGCTGCTTGGATCC
TTAGGACTTGCCGCATGGAATGGGCCGATGGCGATCATCTTCCTCATCGTGGGCATTGCC
CTGGCGTTGCTCATGGTGTTGGGTCCGCAATTGGATGCCTTAAACTCCGGCGATGAAACC
GCACTTACCTTGGGAGTATCCCCTGATCGCCTCCGCATTCTCCTCCTGGTGATCACCTGC
CTGCTGGTGGGATCCATGGTTGCCATGGCCGGCAGCATCGGATTCATCGGCCTTGTCATC
CCCCACCTGGCCAGGCGTTTTGTTAGTGGAAAACACCGACTCATGCTGCCTGTATCCGCG
TTGATGGGCGCAATTTTGCTCATCTGGGCTGATATCGCCGCCCGCACCCTGCTTGCGCCC
CAAGAGATTCCCATCGGCATCATCACCGCACTCATCGGAGCACCCTTCCTCCTGATTCTG
GTTCGCCGGATGCACACCTAC >RXA02794-downstream
TGATTTTTAAGGAATTATGCGTA >RXA02809
GCAGCACTAACCAACGCCCTTTCCTACCTCTCCGCAGAGTGGAACAACAAGGCTGCAGGC
ATCGTCTCCTACGGCTCCGCAATGGGCGTTCGCGCAGCTGAGCACCTCCGCGGCATCCTT
TCCGAGCTTCAGATCGCACACGTTCAAAAGACCGGCCTGCTGAGCATCTTCACCGACTTC
GAATACCCTAACTTCAAGCCTTCCGAGCAGGGCATCTCCTCTGTGGACGCTATGCTTGAG
CAGCTTGTTGTCTGGACCAAGGCAATGTCCACC >RXA02811-upstream
CATAATCACTCTTTCCAGATAGCGGAATCCCTTTGATTGTAACTTGGCTCACCTCGATTA
TGTGTTTATGACATCACACGCACCAGAATCGGGAGGACTT >RXA02811
GTGACAGAGTCAACTCTCGGAGCATCGAATAGCTCCCAAACAATTGAAAATAAAGGCCTC
ACCATCTTGGGCATCAGCGGCCGACGCTTGGCTGCGGTGCTCATTGGCTGGTTTTTTGTC
ATTTTCGACGGCTACGACCTCATTGTGTACGGCACCGTCCAATCGGCCCTGGCTAAGGAG
TGGAACTTAAGCTCTGCAACGCTGGGCACCATCGGCTCCACCGCGTTCTTTGGCATGGCG
ATCGGCGCTGTGTTCATTGGTCGACTGTCAGACCGCGTGGGCCGAAAAGCAGCGGTGATT
GGATCCGTGCTGATTCTCTCTGTCTTCACCATGCTGTGTGCATTTGCTCCAAACCCATGG
GTGTTCGGCGCTTTCCGTTTCATC >RXA02836-upstream
CCATCACTCGGCTTCACCGTCTACGGTGCTGCCCGCAGGACAGAGCGCCCCCAAAAGCTC
GCTTCAGACGGGATCCACCCCCTCGAGATGGACGTCACCG >RXA02836
ATGACAATCGATGAAGGCCGTCGCCAGTTCGAGGTCAATGTATTCGGCGCGATGGCCCTC
ACCCGACTCGTCCTGCCCCACATGCAGAAACAAAAGTGGGGGACGATCGTGAACATCACA
TCGATGGGCGGGAAGATCTACACGCCCTCTCGGCGGCTGGTATCACGGCACCAAGTTCGCC
CTCGAGGCCCTCTCGGACGCCCTCCGCCTGGAGGTCGCCCCATTCGGCATCGACGTTGTT
GTCATCGAACCGGGCGGCATCGCCACCGAGTGGGGAGGAATCGCTGCCGACAATCTCGAC
GCAGTG

>RXA02850

GAAGAGCTTGGCGGAGCAACCACCCACATGGTGACCGCTGGTAACTCCCACTACACCGCT
GCGACCGATGAGGAAGCACTGGATTGGGTACAGGACCTGGTGTCCTTCCTCCCATCCAAC
AATCGCTCCTACGCACCGATGGAAGACTTCGACGAGGAAGAAGGCGGCGTTGAAGAAAAC
ATCACCGCTGACGATCTGAAGCTCGACGAGATCATCCCAGATTCCGCGACCGTTCCTTAC
GACGTCCGCGATGTCATNGAATGCCTCACCGACGATGGCGAATACCTGGAAATCCAGGCA
GNCCGCGCAGAAAACGTTGTTATTGCATTCGGCCGCATCGAAGGCCAGTCCGTTGGCTTT
GTTGCCAACCAGCCAACCCAGTTCGCTGGCTGCCTGGACATCGACTCCTCTGAGAAGGCA
GCTCGCTTCGTCCGCACCTGCGACGCGTTCAACATCCCAATCGTCATGCTTGTGGACGTC
CCCGGCTTCCTC

>RXA02851
CCTCGCCAGAAGGCCGACATCATGATCGGTTCCATCCAGGAAAACATCAACGATGTGGAT
CTGGAATTGGACACCATCATCCCGGATTCCCCGAACCAGCCTTATGACATGAAGGAAGTT
ATTTCCCGCATCGTNGACGACGCCGAGTTCTTCGAGATCAGGAAGACTACGCAGAGAAC
ATCCTGTGTGGCTTCGCTCGCGTTGAGGNCCGTTNTGTTGGCATCGTGGCTAACCAGCCA
ACCCAGTTCGCTGGCTGNTTGGATATTAAGGCATCTGAGAAGGCTGCCCGTTTCATCCGC
ACCTGCGATGCCTTCAACATCCCAATCCTTGAGTTCGTGGACGTTCCAGGCTTCCTGCCT
GGCACCAACCAGGAATTCGACGGCATCATCCGCCGCGGCGCAAAGCTGCTTTACGCTTAC
GCTGAAGCAACCGTCGGCAAGATCACCGTCATCACCCGCAAGTCCTACGGCGGAGCGTAC
TGCGTGATGGGTTCCAAGGATATGGGCGCTGGCCTGGTA

>RXA02865-upstream
GAGCGGGGTTGCTATCGGCCGAAAGTTTAGGGTTTTGTTCAATCTGTTGGTTAGTATTGC
TTGGGTAAACAAGTCATAACAATTTTCATTAAGGGTCGTT >RXA02865
TTGTCGCGCACAGGTGTTTCGAAAAAAACCAAAGCTCACCGCTCCTGTTGTCATCATCGGC
ACCCTCGTCTTGTTGATCATCGCCTTCACCGCTTCCCTCATGCTGGGTCCCGTGACGGTT
CCATTGAATGAGCTTGCAACCAACCCCGTTGTCACCGATATCCGTGCACCACGCATTATC
ATCGCAGCATTGGTGGGTGCGGCGCTGGCTGTCTCCGGTGCGATCATGCAGACGGTGTTT
CACAACCCGTTGGCGGATCCCGGCATTGTGGGTGTGTCCTCCGGTGCAGCTGTTGCAGCT
GTCTTGGCGATTGTCACCGGTGCGAGTTTCTTTGGCCAATGGACCGTTCCTTTTGCGGCC
TTCGTGGGCGCATTGGTCACGGTGGCTGTGGTATATTTGATCGCTAGTTCCCGCGCGATG
GATGGCCGTGGCGCAGATCCGGCCACGTTGGTACTGGTCGGCATGGCTATCACTGCCTTT
TTGGGTGCTGTTATTTCCAGCGCCACTGCGAACGCACCACAAGATTCTGAGCTTCGATCC
GTGACGTTTTGGCTCAACGGCGATCTGGTATCTCGGACGTGGGAACATGTGGGCGTTGCA
ATAATCCCCATTATCGTTGGGTTGATTCTAGCTATCGGCGGTTCCCGCGATCTGAACTTG
TTGCTGCTGGGTGATTCCACAGCGCAAACATCTGGACTCAACGTCAACCGCGCACGCATC
ATTTTGCTAGCACTTGCGGCACTGCTCACCGCCACAGCTGTTGCGGTCTCCGGCACCATT
ACGTTTGTTGGATTGGTAGTACCCCACCTGGTGCGCATTGTTTTAGGTGCCGATCACCGA
GCGTTACTCCCGGCCGCCGCGATTTTGGGCGCCACGTTTGTTATCGTTTCCGACACTGTT
GCCCGCATGATCTTCTCCCCCATCGTCTTGCAAACAGGCGTGGTGGTGGCGTTCATTGGC
TCACCAATTTTCCTTTATTTACTGCTCAGCATGCGCAAGCGACGCGGATTGGGGCTG >RXA02865-downstream
TAAAAACTCATGCCTCAATTAGT >RXA02900-upstream
TATGTCCTTTGGCTCCGGTACCCTGGCAGGAGTACCTGGGCTGTTTTTCTAAAATGGCCT
GACGTTTTCAAGATTGAATTTAAGGAAAGCATCGTAGTTC >RXA02900
ATGAGTAACCCTGCCGCGAGCACACCTGCCAACAATTCGGACGATGTTGCGAAGGAGAAT
TGGGACTCTTCTTTTACGCCGAAGACTGACATTGACTCTTCCCAGCCTGTCAATAACTCG
ACTGGTGAAGCCGCTGCGCGCGCAGTGAACCTGTACAAGGCGTATGGCCAGGGTGATACC
ACTGTCACCGCGTTGGATCACGTCAACGTGGAGTTTGAGAAGAACAAGTTCACTGCCATC
ATGGGTCCTTCTGGCTCGGGTAAGTCCACGTTGATGCACTGCATGGCTGGTCTGGATGCT
GCGACTGGTGGTTCGGCATTCATTGGTGATACGGATCTGTCGCGGTTGAAGGACAAAGAG
ATGACCTCTTTGCGTCGTGATCGTTTGGGATTCATTTTCCAGTCGTTCAACTTGGTTCCT
ACTCTGACGGCGTCGGAGAACATTACGCTGCCTACCGATATCGCGGGCCGCAAGATTGAT
CAGTCGTGGTTCGATGAGATTACCTCTCGTCTGGGTCTGACTGAGCGCCTTAAGCACCGT Attorney Docket No.: BGI-125CP

```
CCTGCAGAGCTCTCTGGTGGTCAGCAGCAGCGTGTGGCGTGTGCTCGTGCGTTGGTGTCT
CGTCCGGAGATCATTTTCGGCGACGAGCCAACCGGTAACTTGGATTCGAACTCTTCTAGG
GAAGTGCTGGATATCCTGCGCACCGCAGTTGATCAGGATGATCAGACCGTTGTGATCGTT
ACCCACGATGCCAAGGCGGCGTCCTATGCAGATCGTGTCATTTTCTTGGCGGACGGTCGT
ATCGTGAACCAGTTGTTTGATCCCACCATCGAGGAAATCTTGGCCACGATGAACGGAATT
GAGGATATTGCC
```

>RXA02900-downstream
```
TAATGAATTCCGGTTCCACAATG
```

>RXN00024-upstream
```
TTAAGACATCAACATATGGCTTGTGCTACTGAAAGATTTTTCTTCTGAAATTCTGTAGAA
ACGCTCCTATGCTCGGGGCAGTAAGTTGTGAGCATAGGAA
```

>RXN00024
```
ATGGAGCACGGCGTGACCGTTATTAAAGGCACTGAATTTGATGTTTTCCCACTAAACCTC
GGTGGAAATACCTTTGGCTGGACCTCGAATAGGGAACAGACCTTCGCGGTTTTGGATGCA
TTCGTGGCAGCGGGAGGAAACTTTGTTGACACCGCCGATTCTTATTCTGCATGGGTTGAA
GGCAATGAGGGTGGCGAGTCGGAGCGGGAGCTCGGCGCGTGGATTAAGGAACGTGGCGCA
GACAAGCTGATCATTGCTACCAAGTCTGGTGCGTTGGAGCCTGTTGCTGGTCGTTCCCGT
GAGGCAACTTTCAAGGCTGTCGAGGGTTCCCTGGAGCGTTTGGGCGTGGAATCGATCGAT
ATTTTTTACTACCACTACGACGATGAGGCAGTCAGCATTGATGAGCAGGTTGCTATCGCT
AATGATCTGATTGCACAGGGCAAGATTAAGCACCTCGCATTGTCTAACTACAGCGCGGAG
CGTTTAGCTGAGTTCTTTGAGAAGTCTGTAGGCACTCCAGCGCAGCCGGTTGCTCTGCAA
CCGCACTACAACCTGGTGTCGAGGAAGGATTATGAGGAGAACGTGCAGCCACTCGCCGAG
AAGCATGGCGTTGCAGTCTTCCCTTATTTCGCGCTTGCCGCGGGTCTTTTGACCGGAAAG
TACACCTCCAAGGAGGATATTCGGGTAAAGCGCGTGCGGGGCAGTTGGATCGTTACGCC
AGCGATGAGGCGTTTGCCGTGGTGACAGAGTTGCGTGCTGTTGCCGATGAGTTGGGTGTT
GCGCCAACGACTGTGGCGCTTGCGTGGTTGGTTGCGCATGGTGTGACCGCACCGATTGCG
TCCGTGTCCAAGGTAGAGCAGTTGAAGGATTTGATGGCTGTGAAGGATGTGGAGCTGAGC
GCTGAGCAGCTTGCACGTTTGGATAAGGTTTCGGAGCCTTTCGCT
```

>RXN00024-downstream
```
TAAGCTCTCCTCAAAAGTAAGTG
```

>RXN00092-upstream
```
CGAAACCAGAAACACCCAGCGGCTCCTCGTCGAAAAGCGAATCTTTGAACTAGAAGCCCA
GGCACGTTGGCTCGACCGAATTGAAGCATTGGAGCAGTAA
```

>RXN00092
```
ATGACAAACACGCCTTTCCCCCTTGAACTTCAAAACATCTCCTGCGCCTTCGGAGAAGGC
CCACGCCACGTCTCCGCGCTCAACAACGTCTCGCTGGCAGTCAATCCCGGCGAACTCGTT
GCCATCATGGGCCCGTCCGGCTCAGGAAAATCCACCTTGCTCAACGTCGCCGGCCTCCTG
CAGCGCGCAACCTCTGGCCATGTGCTTATCGACGGTGCCAGCGCCTCAGACCTCAACGCC
AAACGCGCAGCTGAAACCAGGCGTCGCCACATCGGAGTTATTTTCCAAAACTACAACCTG
GTCCCCACCCTCACCGTCGGAGAAAACGTCGGTCTGCCCCTAGAACTCGACGGCAAAACC
GACCGCCAGGCAGTAGCAATCGCACTCGCGGAAGTCGGCCTCGAAGGCTTCGACGACCGC
TTCCCCGAAGAGATCTCCGGCGGCCAAGCCCAGCGCGTCGCCATCGCGAGAGCCCTCATC
GGCCCCCGAAAAATCTTGCTTGCCGACGAACCCACCGGCGCCCTCGACACCTCCACCGGC
GACGCAGTCCTCCGCGTCCTCCGCCAAAGAATCGATTCCGGTGCCGCAGGCCTCCTTGTC
ACCCACGAACCCCGCTTCGCCGCGTGGGCAGACCGAACAATCATGCTTAGGGATGGTGAA
ATCCAG
```

>RXN00092-downstream
```
TGACCACACTTCTAGCAGCAACC
```

>RXN00099-upstream
```
CTCTGGTGAAGAGGATGTTGACTCGGGAGATTCTTCCACTGATTCACTGATTAAGTGGTA
CCGCGCAAATAGGTAGTCGCTTGCTTATAGGGTCAGGGGC
```

>RXN00099

```
GTGAAGAATCCTCGCCTCATAGCACTGGCCGCTATCATCCTGACCTCGTTCAATCTGCGA
ACAGCTATTACTGCTTTAGCTCCGCTGGTTTCTGAGATTCGGGATGATTAGGGGTTAGT
GCTTCTCTTATTGGTGTGTTGGGCATGATCCCGACTGCTATGTTCGCGGATGCTGCGTTT
GCGCTTCCGTCGTTGAAGAGGAAGTTCACTACTTCCCAACTGTTGATGTTTGCCATGCTG
TTGACTGCTGCCGGTCAGATTATTCGTGTCGCTGGACCTGCTTCGCTGTTGATGGTCGGT
ACTGTGTTCGCGATGTTTGCGATCGGAGTTACCAATGTGTTGCTTCCGATTGCTGTTAGG
GAGTATTTTCCGCGTCACGTCGGTGGAATGTCGACAACTTATCTGGTGTCGTTCCAGATT
GTTCAGGCACTTGCTCCGACGCTTGCCGTGCCGATTTCTCAGTGGGCTACACATGTGGGG
TTGACCGGTTGGAGGGTGTCGCTCGGTTCGTGGGCGCTGCTGGGGTTGGTTGCGGCGATT
TCGTGGATTCCGCTGTTGAGTTTGCAGGGTGCCAGGGTTGTTGCGGCGCCGTCGAAGGTT
TCTCTTCCTGTGTGGAAGTCTTCGGTTGGTGTGGGGCTCGGGTTGATGTTTGGGTTTACT
TCGTTTGCGACGTATATCCTCATGGGTTTTATGCCGCAGATGGTAGGTGATCCTCAGCTC
GGTGCGGTGTTGTTAGGCTGGTGGTCAATTTTGGGATTGCCGCTGAACATTCTGGGACCG
TGGTTGGTGACGCGTTTCACTAACTGCTTCCCGATGGTTGTTATCGCCAGTGTCATGTTT
CTCATCGGTAATGGTGGGTTTTGTTTGGCTCCGGATGTTGCGCCGTGGTTGTGGGCGACG
TTGTCTGGTCTTGGTCCCCTTGCGTTCCCGATGGCGTTGACGCTCATTAATATTCGTGCT
GAAACTAGTGCTGGTGCTTCTGCGTTGAGTTCCTTCGGGCAGGGTTTGGGTTATACGATT
GCGTGTTTCGGTCCCTTGTTGACTGGTTTCATTGTCGATGCGACAGGCAGCTTCCGAACA
ATCTTTGTGCTTTTTGCGGTTGCAACACTCTTCGTTATTAGAGGCGGTTACTTTGCGACA
AGGCAGGTTTACGTCGAAAAGCTTTTAAATCGC

>RXN00099-downstream
TAGGATGGCGCTATGCCGCAAAG

>RXN00113-upstream
TCTGCGCATCCCACTCGAGGAGCTGGCAAACGGCCGCACCATCGATGTTGAGGCACGCAC
CGACTCCATCGAAGAGTCCGCATCCGGCCGTATCGTTACC >RXN00113
GTGCGCATCGTGCTCACCACCGAAGGCGAAGTAGCAGCCAAGCTGGTTACCCGCTTCGCA
ATTCGTGGACGCATCACCACCAACGAAATGGCTGCACCAGCAGATTCCTACGGCGCACGC
GACGAAGTTGTCGAGGCAACCCCTCGTTCCTTCATCCGCCAGGCAACTGTTTCTGCACCT
GCAGACATGACCCCATTCGCCATGGTTTCTGGTGACTACAACCCAATTCACACCTCTGAC
AACGCTGCAAAGCTTGTTGGCCTGGACGCAGCTCTTGTCCACGGCATGTGGCTGTCCGCT
ACCGCACAGCACCTCGCTGGTCTTGGCTCTGAGGTCATTGGTTGGACCTACTCCATGTAC
GGCATGGTTCAACTCAACGACGTTGTTGACATCACCGTCGAGCGTGTTGGCCGCGCAGGT
CTGAAGCCTGCATACGAGGTCACCTGCCGCATTGATGGCAACGTTGTCTCCCGCGGACAG
GCACTGCTCAAGGCTCCTTCCACCGCTTATGTTTACCCAAGCCAGGGCATCCAGGCTAAG
GGCATGGGCCAAGGCGATCGCACCGCAAGCGCAGAGGCTCGCGCTGTGTGGGAGCGTGCA
GATGCACACACCCGCGCAAACCTGGGCTTCTCCATCCAGCAGGTCATTGATGAAAACCCA
ACTGAGCTGAAGGTCGGGGACACCACCTTCGTGCACCCAGCTGGGGTTTTGAACCTCACC
CAGTTCACGCAGGTCGCGCTCGCCGTGGTTGCCTACGCTCAGACCGAGCGCCTCAAGGCT
GCAAACGCAATTGTCGACGGCTCCCTCTACGCAGGCCACTCCCTCGGCGAGTACACCGCA
CTGGCATCCTTGGGCAACATCTTCGAACTCGAAGGCGTCATCGACGTTGTGTTCTCCCGC
GGTTCCGCAATGCACTCCCTGGTTCCACGTGATGAGAAGGGCCGTTCCAACTACGGTCTT
GCCGCATTCCGTCCGAACATGATCAACGTTGCAGCCACCGAGGTGGAGAACTGGGTTGAC
CGTGTCGCTGAAGAATCCGGCGAATTCCTGCAGATCGTTAACTACAACGTTGATGGCCAG
CAGTACGCAGTCGCAGGTACCTTGGCTGGCCTGAAGGCCCTCAAGGCTTCTGCATCTGCA
AACCCACGTGCTTACGTGAACATTCCAGGCATTGCCTTCCACTCCAGCGTCCTG
CGCCCAGGCGTTCCTGCTTTCGCAGAGAAGCTGGACGAGCTGCTGCCAGAGACCATCGAC
ATTGATGCTCTTCGCGGCCGCTACATCCCGAACCTGGTTGCTCGTCCTTTCGAGCTCACC
CAGAGCTTCGTGGATGCCATCCTTGCTGTTGTTCCATCCGAGCGCCTCAAGGGCATCAAG
GTGGAGGACACCGACGAGAACACCCTGGCACGTCTGCTCCTCATCGAGCTGCTGTCTTGG
CAGTTCGCATCCCTGTGCGTTGGATCGAAACCCAGGCTCTGATCATCGATACCGTCGAT
CAGATCATCGAGGTCGGCTTGGCAGCATCGCCAACCCTGACCAACCTGGCACTGCGCACC
ATGGATGTCATTGGCAAGTCCCGCCCAGTATTCAACGTGGAGCGCGACCAGGACACCGTT
ATGCTCAACGATGTTCGCCAGGCACCTGTTGCTGAGGTTGAAGAAGAAGCAGTTGAGGAA
GCACCTGCAGCAGCCGCAGCTCCAGCAGCTGAGGCACCAGTTGCTGCAGCTCCAGTAGCC
GCAGCCGCACCTGCACCTGTTGGAAACGCACCTGAACTGAAGTTCAACGCTGCCAATGCC
ATCATGGTTCTCTTCGCTGTCCAGAACAAGATCAACATTGATCAGATCACCGCAGCGGAT
ACCTCTGAGACCCTGACCAACGGTGTGTCCTCACGCCGTAACCAGATGCTCATGGACATG
```

```
TCCACCGAGCTGTCCGTCCCAACCATCGACGGCGCAGCTGACGCTGACGTAGCTACCCTG
CAGGGACGTGTTGTCACCGCAGCTCCTGGCTACAAGCCTTTCGGACCAGTTCTTTCCGAG
ACCGTTCGTGCACGTCTTCGCGCACTGACCGGTGCAGCAGGTCTGAAGACCTCCTACATC
GGCGATCGCGTGACCGGCACCTGGGGACTTCCAGAAAGCTGGACCGCACACGTTGAGGTT
GAATTGCTGCTGGGCACCCGCGAAGGCGAGTCCGTCCGCGGCGGCAACCTGGGTAGCCTG
CCTGCTAACGCATCCAGCAAGGGCGACGTCGATGCGCTTATCGACGCAGCCGTGCAGAAT
GTTGCTGCAGCCAACGGCACCAGCGTCTCCATGTCCTCCGGCGGTGCAGCTTCAGGTGGC
GGAGTTGTTGATTCCGCAGCACTTGATGCCTACGCATCCACCGTCACTGGTGAAGAAGGC
GTCCTGGCAAACGTTGCTCGCGGCATCCTGTCTCAGCTTGGTCTCGACACCAAGGACGAG
GTTGAAGGCGCAGAGATCGACACCGAACTCTACGACGCTGTCGAAGCAGAACTGGGCACC
GGCTGGCTGAAGCTTGTCACCCCAGTGTTCTCCGCTGATCGTGCGATCTTGTTCGACGAC
CGTTGGGCATCTGCACGTGAAGATCTGGCACGCCTTGCCAACGGCGAGGATATTGCCGTC
GAGCGCTTTGCTGGAACGGGGGAGACCGTCGTCAAGCAAGCTGCATGGTGGGCTGAGCAC
GTTGAAGACACCGCTCTCGCTGCAACCCTGAAGCAGGTTTCCGAGGTGGCTGCGAAGCCA
GCCAACGAGCCACACATCGACGATGTTGCGCTGGTTACCGGTGCGGCTCCTGAGTCGATC
GCCGGTGCAGTTGCGGCTCGCCTGCTGTCCCAGGGCGCGACCGTCATTCTCACCGCATCG
AACGTCTCCCAGGCGCGTAAGGAATACGCACGCAAGCTCTACGCTGCGAACGCAACCCCT
AACGCAAAGCTGTGGATTGTTCCTGCGAACATGTCCTCCTACCGCGATGTTGATGCAGTC
ATCGATTGGATCGGCAACGAGCAGCGCGTCACCGTCGGCAGCACCGTCACCGTGACCAAG
CCAGCTCTGACCCCAACCCTTGCGTACCCATTCGCAGCTCCATCCGTATCCGGTACCTTG
GCGGATGCAGGCCCACAGGCTGAAAACCAGGCACGCCTGCTCCTCTGGTCCGTGGAGCGC
ACCATCGCAGGACTTGCAGATCTTGCATCCCGCGGTGTCGATGGACGCGTCCACGTTGTA
CTCCCAGGTTCCCCGAACCGCGGAATGTTCGGTGGCGACGGCGCTTACGGCGAAGTCAAG
GCTGCTTTCGACGCCATCCTTGCCAAGTGGGGCTCCGAGACCGGCTGGCCACAGTTTGTC
TCCCTCGCACAGGCACGCATCGGCTGGGTCGCAGGCACCGGCCTCATGGGTCGCAACGAC
GTGCTCATCCCTGCCGCTGAAAAGCTGGGCATCCACGTCTACACCCCTGAAGAGATCTCT
TCCGAACTGCTGGGTCTTGCATCCGCAGAATCCCGCGAAAAGGCTCTGGAAGCACCGATC
GATTACGACCTGACCGGTGGACTTTCCGGTGGCGTATCCATCGCAGCACTGGCAGCATCC
CTCGAGTCCGACGCAGTAGAGACCACCTCTGCAGCAGAAGACACCATCAAGGCGCTTCCA
TCACCTAAGCACCCAGAGCAGCCAGTGGGCACGCCAGTTGGAGAGGTCAAGACCGATCTC
GAAGACATGGTTGTCATGGTTGGCGTTGGCGAAGTCTCCTCATGGGGCTCCGGACGTACC
CGCTTCGAAGCTGAGTACGGCATCCACCGCGACGGCTCCGTTGACCTCACCGCAGCAGGC
GTCCTTGAGCTTGCATGGATGATGGGTCTGATCTCCTGGAGCGAAGATCCAAAGCCAGCC
TGGTACGACGCTGACGGCACCGAAGTGCCTGAAGAAGAGATCTACGAGCGCTTCCGCGAC
GAAGTCATCGCACGATGCGGTGTTCGTGAGCTTGTCGACGACGCATTCCTCGTCGACGGC
GGCTCCCTCGACGCAGCTGAAGTCTTCCTCGACCGCGACATCTCCTTCTCCGTAACCTCT
GCTGAAGAAGCACAGGCCTACGTCGATGCAGATGCTTCCGTGACCGTTGAAGAAGCAGAC
GGCGAATGGATCGTGACCAAGAAGAAGGGCTCCACCTCCTTCGTGCCACGCAAGGCAACC
CTGACCCGCTCCGTAGCAGGCCAGCTGCCAACCGACTTCGACCCTGCCAAGTGGGGTATC
CCAGCCTCCATGATCGATGCACTCGACAACATCGCAGCGTGGAACCTGGTCACTGCAGTC
GACGCCTTCCTGTCCTCCGGCTTCAGCCCAGCAGAACTCCTGCAGTCCATCCACCCAGCT
GACGTGTCCTCCACCCAGGGCACCGGTATCGGTGGCATGCAGTCCCTACGCAAGCTGTTC
GTCAACCGCTTCCTCGGCCAGGATCGTCCATCCGACATCCTCCAGGAGACCCTGCCAAAC
GTTGTGGCTGCACACACCATGCAGTCCTACGTCGGTGGCTACGGCCAGATGATCCACCCA
GTGGCAGCATGTGCAACCGCAGCTGTCTCCGTGGAAGAAGGCGTGGACAAGATCCGCCTC
AACAAGGCAGATTTCGTTGTCGCCGGTGGTATCGATGACATCCAGGTTGAATCCCTGACC
GGCTTCGGTGACATGAACGCCACCGCAGACACCCAGGCAATGCTGGACAAGGGCATCGAC
CCACGCTTCATCTCCCGCGCAAACGATCGACGTCGCGCAGGCTTCCTCGAAGCAGCAGGT
GGCGGTACCGTCCTCCTGGCACGTGCATCCGTTGCTGCTGAACTGGGACTGCCAGTTCTC
GCAGTTGTTGCACACGCACAGTCCTACGCCGATGGTGCTCACACCTCCATCCCAGCACCG
GGACTTGGCGCACTGGGTGCAGCACGTGGTGGCAAGAAGTCCGTACTTGCTCGCGAACTG
AACAAATTGGGTCTGACCCCAGATGACGTTCGCGTGGTCTCGAAGCACGACACCTCCACC
AACGCCAACGATCCAAACGAGTCCGAGCTGCACAACCTGCTGTGGAAGACCATTGGACGC
GAAGCCGACAACCCGATGTTCGTCGTCTCCCAGAAGTCCTTACCGGACACTCAAAGGGC
GGTGCAGCACTCTTCCAGATCGGTGGACTTGTCTCCATCCTGGAAACCGGCAAGCTGCCA
CAGAACGCATCCCTTGACTGCGTTGACCCAGAGATGGAAGCAAAGGGCGAGAACTTCGTC
TGGCTGCGCAAGCCACTGGATCTCGGCGCAGGCTCCATTAAGGCCGGCGTACTTACCTCA
CTGGGCTTCGGCCACGTGGCTGCAGTCGTCGTGCTGGCAACCAGCGGCATCTTCGAGCAG
GCAATGCGCAACGCAGGCCTCGAAGTCGAAGCATGGCGTGCACGCGCAACCCAGCGCCTG
CGCACCGGTGCAAACCGCCTAGAAGCTGGCATGGTTGGCCGAGCACCATTGTTCGAGCAG
GTCGACGGACGTCGCCTGCCAGAGCATGGCGCTCACCAAGCAGAGATCAACTTGCTTATC
```

GACGCTGACGCTCGCCTCGGTGCTGACGGCATCTACCAGGGC

>RXN00113-downstream
TAAACGTTAGATAGCTAAGAAAG

>RXN00164-upstream
CTGCTTTGCGGGAGGTTATGAAATGAGTGGGGAGACGTCGAAAAGCATGCGCTTTCCGTT
GGCCAGCCTGCCGCAAGTGCGGCGCGAGGTGGCCCGGCAG >RXN00164
GTGGGTCGTATTCCGCGGGCGAAGTGGTGGTTTTTAGGCGCGCTGGTGTTGCTGAGTGCG
GGCGCTTATGCGTCGGTGCTGGTGCCGCAGGTGCTGGGGCGGATTGTGGATCTGGTGTCC
GATGGCGCGCAGATGCGTGATTTTGTTGAGCTCAGTGTGATTCTCATTGCGGTGGCAATT
GCCGGCGCGGTGCTCAGTGCGTGCGGGTTCTATGTGGTGTCGCGGATTTCTGAGAAGATT
ATCGCCAATTTGAGGGAAGATATGGTGGGCACCGCGCTTGGGTTGCCCACGCACCAGGTG
GAAGATGCGGGCTCTGGCGATTTGGTGAGCCGCTCCACCGATGATGTCTCCGAGCTATCC
GCAGCGGTGACAGAGACCGTCCCGATTTTAAGTTCCTCACTGTTTACCATTGCCGCGACG
ATCATTGCGCTGTTTTCTTTGGACTGGCAATTTGTGCTCATTCCTGTCGTGGTGGCGCCG
GTGTACTACTTCGCGTCCAAGCACTATTTGAGCAAGGCGCCGGATCGGTATGCGGCAGAA
CGCGCGGCGATGGCGGAGCGTGCGCGAAAGGTACTTGAGGCTATTCGCGGGCGTGCAACT
GTGCGGGCGTATTCCATGGAAGATGCCATGCATAATCAGATTGATCAGGCGTCGTGGTCT
GTGGTGGTCAAGGGTATTCGTGCGCGCACCACCATGTTGATTTTGAACATGTGGATGCTG
TTTGCGGAATTCCTCATGCTCGCGGTCGCGTTGGTGATCGGCTACAAGCTGGTCATTGAT
AATGCGCTGACGATCGGCGCGGTTACCGGTGCCGTGCTGATGATTATTCGTCTGCGTGGC
CCGATGAATATGTTCATGCGCGTGCTCGACACCATTCAATCCGGCTATGCGTCGCTGGCG
CGCATCGTGGGAGTTGTTGCCGGATCCGCCGATTCCTGTGCCCGACAGCGGTGTGAAAGCA
CCTCAGGGCAAAGTGGAATTGCGCAACGTCAGCTTTAGCTATGGCGATTCCTGGGCGGTG
AAAGACATCGACATCACGATCAATTCCGGCGAAACTGTCGCGCTCGTGGGCGCATCTGGC
GCAGGTAAGACGACGGTCGCCGCCTTGCTGGCGGGCTTGCGGGTGCCAGATCAAGGCAA
GTGCTTGTCGACGACTTCCCCGTCTCTCACCTCTCTGACCGCGAGCGTATCGCCCGCTTG
GCCATGGTCAGCCAGGAGGTTCATGTTTTCTCCGGCACGCTGCGCCAGGATCTCACCTTG
GCTAAACCAGATGCCTCCGATGAGGAATTAGCGCATGCTCTTGGGCAAGTTAATGCCCTT
GACTGGTTGGAGAGTCTTCCAGAAGGACTGGACACGGTCGTTGGTGCGCGAGGAATCCAG
CTAGAACCAGTGGTGGCTCAGCAGTTGGCGTTGGCCCGGGTGTTGTTGCTCAATCCGGCG
ATCGTCATCATGGATGAAGCCACGGCAGAAGCAGGATCGGCGGGTGCCAGCGCACTGGAA
GAGGCTGCAGATGCAGTGAGCAAGAACCGTTCCGCATTGGTGGTGGCGCACCGGTTGGAT
CAGGCATCGCGGGCTGATCAGATTCTGGTGATGGATAAGGGGGAGGTTGTGGAATCCGGT
ACTCACCAGGAGTTATTGGATCACGGGGGTATTTATCAGCGTCTGTGGACTGCGTGGAGT
GTCGGAAGA >RXN00164-downstream
TAGTTGACTGTTCAATGCGTTGA >RXN00193
AAAGCTTTCTNCCAACGCGAAGGTTTCATCTCAGCCTTCGGTTTCACCGTCCTCGTGGTC
ATCGTCTCCGTGATCACAGTCAACATCTTCGCCTTCCTCTTGGCGTGGTTGCTGACCCGC
AAACTCCGCGGTACCAACTTTTTCCGCACAGTCTTCTTTATGCCGAACCTTATCGGCGGC
ATTGTGCTGGGTTATACCTGGCAGACCATGATCAACGCCGTGCTTTCGCACTATGCCACG
ACTATTAGCGCGGACTGGAAATTCGGCTAACGCCGGCCTCATCATGCTACTTAACTGGCAG
CTCATCGGCTACATGATGATCATTTACATCGCCGGCCTGCAAAACGTCCCACCAGAGCTC
ATTGAGGCTGCCGAACTCGACGGCGTCAACAAGTGGGAGATGCTGCGGCACGTCACTATT
CCGATGGTCATGCCATCCATCACCATCTGCCTCTTTTTGACTTTGTCGAACTCCTTTAAG
CTCTTCGACCAGAACCTGGCGCTGACCAACGGCGCTCCTGGCGGGCAAACTGAGATGGTG
GCGCTCAACATCATCAACACGCTGTTTAACCGTATGAATGTCGAGGGCGTCGGT >RXN00201-upstream
ACGTCGCGGACTTCAAGTAGTCGGCGATGAAAAAGTCCGTTTACTAAACCCCGATCTGTG
TTACGCCATCGCGCGGCTCGGGCACACCGATACCTGGGCA

>RXN00201

Attorney Docket No.: BGI-125CP

```
GTGGCAGATTGCGGATTACCCATCCCAGAACACGTAGAGATCATCGATTTGGCACTCGTG
TTTGGGATCCCCACCTTTGAACAAGTACTGAATGCTCTCAAGCCGGAAGTAGTTGTGGAA
GGCGCGGTGATTGCCGAAGGGGCACCCCAACGTATCCGCGAAATGGTGGATACGGATGTG
GAAGTATGTGCG

>RXN00243-upstream
CACTGCGCCAGATTTTTGATGCCGACACTGTGGCAGGTGTGCGCGCTGAGTACGAAAAAT
TTAACAAAGCAGCCCATGATGGAAATGAAGAGGAACAGAA >RXN00243
GTGACCAGCGAACAAGCTTTAGATCCTATCCACCCAGGTCAGTTCCGTCTTTCTCGGATT
CAGTTGATCAACTGGGGAACCTTCCACGGAACGGTGGACATTCCTGTGACCAGGGAAGGA
ATCTTAGTTACCGGTGGTTCGGGATCAGGAAAATCCACGCTGATTGATGCGATCACGGCG
GTATTGCTTCCGCAAGGAAAGCTGAGGTTTAACTCTGCCGCACAGGCTAATACTCCGCGG
AATAAGGGACGCAGTTTGGTTACCTATATCCGTGGCGCTTGGCGTGCGCAGGAGGATCCG
CTGCAGGATCAGATTGTCTCCACGTACCTACGTCCCCGCGCAACCTATTCGCTGGTTGGA
TTGACTTATTCCAACGGTGAAGGCGTCGAGCACACCTTGGTGGCTATTTTCTATCTGAAA
TCGGGACACAATTTAACCTCCGATATTTCTTCATATTATGGTGTGTTTCCCGTTGATCAA
GACATCAATGCGCTGCTGGATTTCCTGAAAGAGGGCATCGATAAACGCCAGATCAGAGCT
GCTTTCAAGGAAGCCATCTTTAGCGAGCAGCATTCTGTATTCTCCGGCAGGTTTAGAAGC
CGTTTGGGGATCTCCAGTGAGGAAGCTTTGCTGTTGTTGCACCGCGCGCAGTCGGCGAAA
GATCTTCAAAGCTTGGATGATCTATTTCGGGATTACATGCTGGTGGAACCGGATACGTTC
AGCATTGCCAAAACTGCCGTGGAACAATTCCAAGACCTTGAAGGTGCTTATGAGCAGGTC
GAAGATATTAAACGGCAGATCCACACCCTGGATCCTTTGGTGCAGCTGAAGAATCGGCGA
GAGAAAGCGCAACAGTCCAAAGATCATGCCAATGCACTGAAGAAGGCGCTGCCGACTGTC
GGGAATCGCATTAAGAAGGAAGAGCAAGAACCGCTGGTTCGACAATTTACTGTCGAGCAA
ACGCAGCGAAGTCGAAGGTGGAGTCCGCCAAAATTGAGACAGATCGTGCCCGCGAAA >RXN00243-downstream
TGAAAACCCTCGCGCACGACAAC >RXN00297-upstream
AACAAGGCACCGGAAAACAAGCAACGCACCTTGCAGAGGTGGTCTTAAGCATCTTGGAGC
AAAACAACATGGCACAATAACGATCATGCAACAGGTGCTC >RXN00297
ATGGGTTTCACGGTGGTGTTCATCGTCATCGGAATAGGTTGGATTCTCGGTAGAAGAGAC
ACCTTGGGCACACATGCCCAGAAACCTTTGAGCCTGTTTGTCTATTACGTGGCCACCCCA
GCGTTGTTGTTTGATCGGGTCACCAAGTCAGATACCTCGACGATTTTCTCTCTGAACTTC
GTGGTCATTGCACTCTCTGCGTTGATCGTAGGTTTCCTGTTTTTCCTACTCATGCGGTTC
GTGATCAAAAGAACTGCCGCAGTATCGGTGATCGGCATGCTAGCTGCGTCCTACGCCAAC
GCCGGTAACCTGGGTATCCCTTTGGCAGCCTATATTTTGGATGATTTCACCGTGGTGATT
CCCGTGATTTTGTTCCAGGTGGCGTTCTACGCACCGATCACCATGACCATCATGGAGATG
CTGACCAACAAGAAATCCACCAACTTGGTGCGCAACCTCCTGGTCACGCCACTAACCAAC
ACCATGGTGCTCGCAGCGATTGCCGGTATTGCTGTGTCTTTGACTTCGATGAGCGTGCCC
GTGGTGATTGCTCAGCCAGTGGAAATGTTGGCGAATGCTTCAGTGCCACTGGCTTTGGTG
GTGTTCGGACTGTCCTTGTCCAAGAGCAAGATCCTGGAAAAGGGGCAGGTATCCAGGCGC
GATGTGTTTACGGCGGCACTGTTCAAGAATGTTCTGCACCCAATTGTTGCGGGACTTTTA
GCCTTAGCCTTTGGTATGGAAGGTACTGCCTTGTTGTCGGCGGTGATTCTCGGTGCACTG
CCAACAGCGCAGAATGTCTACACCTACGCGTTGCGATTTAGAACAGCTGAATCGATGGCG
AGAGACACAGGGGTGGTCACCACACTCATTTCCTTCCCCGTATTGGTGGCGGTCTCCATT
ATCTTTGGATCT >RXN00297-downstream
TAGGGTTAGCATTAGTGGTCATG >RXN00298-upstream
TTTAGACAAGTTCTGGTTAAAATTCTTCATGAAGGTGAGAATCTGGGAATTTCTCGGTAC
TCTTTCAGATTCGTAGTTATCCACTGATTGGAAGAATGAG
```

Appendix A, page 78

Attorney Docket No.: BGI-125CP

>RXN00298
ATGAGCTCAAATATAGCTATCACGACCGAGCCTGAAGGGAAAAATAAAAAGGGTCTCAAA
TCAGACCCGTTCATTTTTTCCATTTCTGTCGGTTTTATCGTGGTGTTTGTCATCGCCACA
ATTGCGCTAGGCGAGAAAGCTCGAACAACCTTTTCCGCGATTGCCGGCTGGCTCTTAGAA
AATTTAGGGTGGATGTATATCGGGGGTGTCTCCTTGGTTTTCATTTTCCTCATGGGTATC
TTTGCGTCCCGGTATGGCCGGGTAAAACTTGGTGATGACGATGATGACCCCGAGCACACC
CTAATCGTGTGGTTCTGTATGCTTTTTGCTGGCGGTGTCGGTGCAGTCTTAATGTTTTGG
GGTGTTGCCGAACCGATTAACCACGCGTTCAACGTGCCAATGGCTAATGAAGAATCCATG
AGTGAAGCCGCAATTGTGCAGGCTTTTGCTTATACTTTCTATCACTTCGGTATTCACATG
TGGGTAATCATGGCACTCCCAGGATTATCATTGGGATACTTTATTTACAAACGTAAGCTA
CCTCCCCGTCTATCCTCTGTGTTTTCTCCGATCTTGGGTAAGCACATTTATTCCACACCC
GGCAAGCTCATCGATGTACTGGCCATCGTAGGCACCACGTTTGGTATTGCTGTGTCAGTA
GGTCTTGGTGTGCTGCAAATCAATGCAGGTATGAACAAACTATGGAGCACCCCGCAAGTA
TCGTGGGTTCAGCTTTTGATCATCTTGATCATCACCGCGGTTGCATGTATTTCCGTTGCT
TCCGGTTTGGATAAGGGCATTAAGTTACTGTCCAACATTAATATTGCAATGGCCGTTGCG
TTGATGTTCTTCATCTTGTTCACTGGTCCAACCCTCACATTGCTGCGCTTTCTCGTAGAA
TCCTTCGGAATCTATGCATCCTGGATGCCTAATCTGATGTTTTGGACTGACTCTTTCCAA
GATAACCCAGGCTGGCAGGGCAAATGGACGGTGTTCTATTGGGCATGGACTATTTGTTGG
TCGCCATATGTCGGCATGTTCGTGGCGCGTATTTCGCGTGGACGTACCGTCCGTGAATTT
ATCGGTGGGGTTCTAGCTCTGCCAGCGATCTTTGGCGTAGTTTGGTTCTCTATCTTTGGT
CGTGCAGGCATCGAAGTGGAACTGAGTAACCCAGGTTTCTTGACCCAGCCAACTGTTGTT
GAAGGTGACGTGCCAGCAGCGCTTTTTAATGTGCTGCAAGAGTATCCGCTGACTGGAATT
GTCTCCGCGTTTGCACTTGTAATTATCGTGATTTTCTTTATCACCTCCATCGATTCCGCA
GCGCTAGTTAACGATATGTTCGCTACCGGTGCAGAAAATCAAACACCGACTAGTTACCGC
GTGATGTGGGCCTGCACCATTGGGGCGGTCGCAGGTTCCTTGCTGATCATTTCCCCATCC
TCTGGTATTGCCACGCTGCAAGAAGTGGTTATCATCGTGGCTTTCCCATTCTTCCTCGTG
CAATTTGTCATGATGTTTTCTTTGCTTAAAGGCATGAGTGAAGATGCTGCTGCGGTTCGT
CGTGTGCAGACTCGTCAGTGGGAAAAGACTGATACACCAGAAAAACTTGAAGAGCATTCG
TCCCAACCAGCCCCGGGCTATGATGACGAGGGCAACCCCTTGCCAATGCCTGCCCTCGAA
CATGATGAGGACGGTAACATTGTTATCCCAGGCAACGTAGTCATTGAAGGTGATCTTGGG
GTAGTTGGTGATGTGGTCGACGATCCTGAGGAAGCCCAAGAGATGGGGTCTCGTTTTAAG
ATCGTCGAGCAAACTCGGCCCCAGTCCAGGGACGAATACGATATT

>RXN00298-downstream
TAAACGATTGCTTTTCGACGCAC

>RXN00349-upstream
TGTGTACATCACAATGGAATTCGGGGCTAGAGTATCTGGTGAACCGTGCATAAACGACCT
GTGATTGGACTCTTTTTCCTTGCAAAATGTTTTCCAGCGG >RXN00349
ATGTTGAGTTTTGCGACCCTTCGTGGCCGCATTTCAACAGTTGACGCTGCAAAAGCCGCA
CCTCCGCCATCGCCACTAGCCCCGATTGATCTCACTGACCATAGTCAAGTGGCCGGTGTG
ATGAATTTGGCTGCGAGAATTGGCGATATTTTGCTTTCTTCAGGTACGTCAAATAGTGAC
ACCAAGGTACAAGTTCGAGCAGTGACCTCTGCGTACGGTTTGTACTACACGCACGTGGAT
ATCACGTTGAATACGATCACCATCTTCACCAACATCGGTGTGGAGAGGAAGATGCCGGTC
AACGTGTTTCATGTTGTAGGCAAGTTGGACACCAACTTCTCCAAACTGTCTGAGGTTGAC
CGTTTGATCCGTTCCATTCAGGCTGGTGCGACCCCGCCTGAGGTTGCCGAGAAAATCCTG
GACGAGTTGGAGCAATCCCCTGCGTCTTATGGTTTCCCTGTTGCGTTGCTTGGCTGGGCA
ATGATGGGTGGTGCTGTTGCTGTGCTGTTGGGTGGTGGATGGCAGGTTTCCCTAATTGCT
TTTATTACCGCGTTCACGATCATTGCCACGACGTCATTTTTGGGAAAGAAGGGTTTGCCT
ACTTTCTTCCAAAATGTTGTTGGTGGTTTTATTGCCACGCTGCCTGCCATCGATTGCTTAT
TCTTTGGCGTTGCAATTTGGTCTTGAGATCAAACCGAGCCAGATCATCGCATCTGGAATT
GTTGTGCTGTTGGCAGGTTTGACACTCGTGCAATCTCTGCAGGACGGCATCACGGGCGCT
CCGGTGACAGCAAGTGCACGATTTTTCGAAACACTCCTGTTTACCGGCGGCATTGTTGCT
GGCGTGGGTTTGGGCATTCAGCTTTCTGAAATCTTGCATGTCATGTTGCCTGCCATGGAG
TCCGCTGCAGCACCTAATTATTCGTCTACATTCGCCCGCATTATCGCTGGTGGCGTCACC
GCAGCGGCCTTCGCAGTGGGTTGTTACGCGGAGTGGTCCTCGGTGATTATTGCGGGGCTT
ACTGCGCTGATGGGTTCTGCGTTTTATTACCTCTTCGTTGTTTATTTAGGCCCCGTCTCT

```
GCCGCTGCGATTGCTGCAACAGCAGTTGGTTTCACTGGTGGTTTGCTTGCCCGTCGATTC
TTGATTCCACCGTTGATTGTGGCGATTGCCGGCATCACACCAATGCTTCCAGGTCTAGCA
ATTTACCGCGGAATGTACGCCACCCTGAATGATCAAACACTCATGGGTTTCACCAACATT
GCGGTTGCTTTAGCCACTGCTTCATCACTTGCCGCTGGCGTGGTTTTGGGTGAGTGGATT
GCCCGCAGGCTACGTCGTCCACCACGCTTCAACCCATACCGTGCATTTACCAAGGCGAAT
GAGTTCTCCTTCCAGGAGGAAGCTGAGCAGAATCAGCGCCGGCAGAGAAAACGTCCAAAG
ACTAATCAGAGATTCGGTAATAAAAGG
```

>RXN00349-downstream
```
TAAAAATCAACCTGCTTAGGCGT
```

>RXN00368-upstream
```
TTCTTCCAAAACGCAATGAACTAGTTTTCCTATGCAGTTATCTCCTTCAAATACGTCGAC
GCAGCGCTTTCACATCTCTGCGTTGACGTCTTTGTCTTTC
```

>RXN00368
```
ATGCGTCTGGGTGTGTGGCTGATTGTCGCGGGGTTGTTTATCACTCCGTTGGCGCTGGTG
GTGGGCTTGGCGTTGGGAGGCAATCAGTTTCCTGCTCTGTGGGATTCCGGATTGGGCAAA
GCCCTATGGAATTCCGCCTATACAACAGTGCTTTCTGCGGTGGGCGCGACCATTATCGGC
ACGATCATGGCTCTCACGCTGGACCGAACTGATGTTTTCGGGCGCACCGCGTTGCGGTTA
TTTTTGTTATCCCCGCTGTTGATCCCTCCGTTTATTGGGCGTATTGCGTGGTTGCAGCTG
TTCGGGAAGAACCAGGGCATCAACCGGTTTTTCGGCACGGAAGTGTGGGATATTTACGGC
GCTGATGGTGTGACATTTTGTTGATTGTGCACTCCTATCCCACTGTGTACATCATTGTT
TCGGCAGCTCTGAGGCAACTTCCTAGTGATTTGGAGCAAGCTGCACGGATCGCGGGGGCG
GATACTTTTACGGTGTTGCGCACCATCACACTCCCACTGCTCAAACCTGCATTGTTGTCG
GCGTTTACTCTTACCACAGTGGCGAACCTCGCCGACTTTGGCATTCCAGCTCTGTTGGGA
TCGCCAGCGCGTTTTGAAACCTTAGCCACCATGATTTATCGCTTCATGGAATCCGGCACC
GTGAGCAATCCATTGCAGGTGGTATCCACCATTGGCATCGTGTTGTTGTTCCTGGGAATC
GCAGCAGTAACCGCGGATTATCTGGTGTCTTTGTACGCGGCATCAAAGTTGCAAGACGCA
GGAACACCGCATCGCTTTACTCTCAACAAATCACGAATCCCAGTCAGCGTGATCACGTGG
ATCATCGCGTTGATCATCACCGCCGCCCCGCTGCTGGGTCTGGCATACAGAGCATTACTG
CCTGCCCCAGGTGTGCCGTTCAACCTAGACAACATCACGCTCAACAACTTTGAAGCAGCA
CTGAGCAATCCACGAGTAATCGAAGGATTCAGCAACTCCCTCATGTTATCCCTGGGTGCA
GCCCTAATCTGTGGGGTGCTGGGATGGCTGATCGGAGTGCTCATCACCCGAACCCAGCAT
TTCGCCAACGTACCGTTGACACTCACTGTGCTGCTTCCCACCGCACTGCCGGGCATGATC
ATCGGCGTCGGCTGGCTCATTTTGGGCAGATACACCGGAATTTACAACACACCTTGGGTG
ATTTTGGGTGCATATGTGTGTGCTTTTACCGCGCTGGTTGTCCAAGCTGTACGCGGACCA
CTCAGTCAAGCACCCGAAGCAATCGAAGAAGCCGCACGAATCAGCGGCGCAGGCAGATTA
CGATCCATCATGGACACCACCGGAGCGATGGCAATTCCCGCAGCTTTCGCCGGCGCAGTG
CTGGTTGCGGTAACTGCGGTTCGAGAGTTAACCGTGTCCATTTTGCTCATCGCGCCGGGC
ACCACCACCCTGGGTGTGCAGGTGTTCAATTTGCAGCAGGCGGGAAATTACAATCAGGCA
TCGGCGTTGTCGTTGATGTTTGCGATTATCGGTATCGTGGCGCTCGCGTTGACGGTGCGC
AGCCAGAAGGAGTTT
```

>RXN00368-downstream
```
TAGGTGTCATCGATCAAATTGCG
```

>RXN00378-upstream
```
ACCGTGAGCCTTATACTGTGAGGACATTAAAAGTGACACCTCTTTTTCTATCTTTTACAA
CCCAAGAAGGTTTATCGTGAGCACACCGGATTCTTCCTCG
```

>RXN00378
```
GTGGACAAGGCCGTAAACACTGCTATCTCTGACGCCAAAACAGCGGCGCTCAAGGCAGGT
GTTGGATTGAACCGAGCCACCGCCTCAGAAGAAGAGGAAGATTTAAGCTCAAGCATTAAG
GTTTCTTTGGCCTTTGAGCTCGAGGGGTTAAGCAATGCACCATCGTTGATGGTGGTGGAA
AAAGCCCTAGAGAAGATCCCCGGTGTATCCGCGGATCTGATTTACCCTTCACAAACTGCA
TGGATTACAGCAACTGATCGGGTACATCCCGAAACCCTCATTGAGGTGTTTGAGCAGTTC
GGCATCAAAGCACACCTTTCTAATTCATCGCTGCTGCGCAGGCATCAACAGCTCAGCGCG
GAAGTAAATAGGGAAGCACGCCTTGATCGTTACCGCTCCCGAATGATGCCAAGCGAATC
TCGCCTCGTGTGCGAAGGCATAACCGACAAGAAATGGTACATGCGGTACGCGCTCGTGAA
AGTGGTTGGATTAAACGCAGGAATCACACCACCTCGCAGCATGAAGACCCAATGTCGGGC
```

Appendix A, page 80

```
GATGTGCTGTTCACCGCCCGCGCACTGATTACACCTAAGCGTTTGTGGGTGTCGTTGCCG
TTTGCGCTCATCGTATTGGCGTTATCGTTGAATCCTTCGTGGCAGTTTGATTATTGGCAG
TGGTTGTCCGCTGTGTTGGCTATTCCTGTGGTGGTGTGGGGTGCCTGGCCGTTTCACCGC
GCTGCAGCAGGCGGTATTCGTCGAGGAATTCCGCTCTTGATGCGACCAGCTCAATCGCT
ATTGCTGCTGCATACGCGTGGTCTATCGCCATGCTGTTGTTTGAAACCCCAGGAGGTAAA
TCCTGGCGGTCATATCCGTCCTGGTTCGCTTTTGACCACGGCACGTTGACCCAAAACGAG
ATTTATTTTGATGTGGCCTGCGGAATCACCGTGTTGCTTCTTGCCGGACGGCTGCTGACA
AGGCGTCGAAGCCAATCCAGTTTGTTAGCGGAACTTGGTCGCCTCCAAATCGATCCACAG
CGCATTGTCACTGTGGTGCGTAAACACCGATTGAAGCGCGTAGTCCAGGAACTGAACATT
CCAGTGCAGGAAGTCCGTGTCAATGACGATGTGAAAGTTCCACCTAATACCACGATCCCT
GTGGATGGCACTGTCATCGGTGGCGGTTCGCGGATCGCAGCTAGCATCATCATGGGACAA
GACCAGCGTGATGTAAAAGTAAATGACAAAGTTTTCGCCGGCAGCCTCAACCTCGAATCC
GAAATCAAGGTTCGTGTTATTCGCACTGGTCACCGCACCCGCATCGCCGCGGTACATAGG
TGGGTTAAAGAAGCGACGTTGAAGGAAAACCGCCACAATAGGGCAGCGATCCGTTCGGCC
GGTAACCTTGTGCCCATCACGTTCACCCTTGCTGTGGTGGACTTCTGTCTGTGGGCACTG
ATCTCTGGAAACATCAACGCTGCATTTACCACTACCTTGGCTGTCCTTGCGTGCGTGGCT
CCGGTGGCCTTAGCGTTGTCTGCTCCACTTGCCACGAGGAATTCCATCGAAGCTGCAGCA
CGACACGGTATTTTGGTCCGCTCTGGTGAAATTTTCCGAGTTCTCGATGATGTGGATACT
GCCGTATTTAATCGTGTGGGCACACTAACCGATGGCGAAATGACAGTGGAAACCGTCACA
GCAGACAAAGGCGAGGACCCAGAACTAGTGCTGCGTGTCGCCGGGGCGTTGGCCATGGAA
TCCCACCACGCGATTTCCAAAGCACTGGTGAAAGCATCCCGTGAAGCTCGTGATACCGGC
GCCGGTGGTGAAGATGTCCCACACTGGATTGAAGTAGGCAACGTGGAAATCACCGAAGCC
GGCTCATTCCAAGCAACCATCGAGCTGCCACTGATCAAACCATCTGGCGAAAAAATCATG
CGCACCACAGAAGCACTCCTGTGGCGACCACGATCCATGACAGAAGTCCGTGAGCACTTA
AGCCCCCGACTAGTGGCAGCAGCAACCTCAGGTGGCGCACCACTGATCGTGCGATGGAAA
GGCAAAGACCGCGGAGTTATCACTCTAAGTGACCACGTGAGATCAGATTCCTCCGATGCG
ATTATTGCGATTGAAGAACAAGGCATCGAGACCATGATGCTTTCACGTGATACTTACCCG
GTGGCACGTCGATACGCAGACAGCTTAGGCATCACCCACGTCTTGGCCGGCATCGCGCCG
GGCAAGAAAGCCCAGGTCGTCCGTGCAGTCCACACCCGCGGATCCACTGTCGCGATGATC
GGCGATGAATCAGTAATGGACTGTTTGAAAGTCGCTGACGTGGGTGTACTGATGGGCGTC
GATCGTCCCTCAGATCTGCGTGATGATTCCGATGACCCGGCAGCTGACGTTGTGGTCATG
CGCGAAGAGGTCATGAGCGTGCCGACGCTGTTTAAACTGGCTCGACGCTACGCCAAGTTG
GTCAATGGCAATATTGCTCTGGCCTGGATCTATAACGGTGTTGCCATGGTGCTTGCAGTG
TCTGGCTTGCTGCATCCAATGGCTGCGACCGTGGCTATGCTGGCGTCTTCGCTGCTTATT
GAATGGCGCTCGGGCAGGGCGCGCAAGTAC

>RXN00378-downstream
TAACCAGCAATTCCCAAGCCCAA

>RXN00410-upstream
GTGTTGATGCGTTAGTCCACCCACGCAGCTACGCCCCAAAGGAATAATCTTGAACCCTGC
CACAGATAACGCTCCGCCGGTCCTTTCAGCCCAAGATCTC >RXN00410
ATGATGATCTATGGAAAAGGATCAACAGAAGTTCGGGCTCTCGATGGCATTTCTGTACAG
ATTCAGTCCGACAAATGGACCTCCATCATGGGCAATCAGGCTCTGGCAAAACAACTCTG
TTGCAGTGCCTTTCCGGATTGGCGCAGCCAACCTCAGGCAGAGTGACACTGAACAAAAAC
AACATCACGTTGAGCTCCCTGTCAGAAAATAAGCGTGCCAAGCTGCGTCGCACGCACATC
AGCATGGTGTTTCAGGATTTCAACTTGGTGCCTATTTTGTCGGTGAAGGACAATATTTTG
CTGCCGTTGCGTCTTGCGCATCGCAGGGTGGATAAGCAGTGGTTTGAACACATCACCAGT
GTGTTGAAGATTGATAATCGTATGCGCCATTTGCCTGGGGAGCTGTCTGGCGGTCAGCAA
CAACGCGCCGCGATTGCCCGGGCGTTGATGTCTAGGCCCGATATTGTCATTGCGGATGAG
CCAACAGGAAGTTTGGATTCCGTCACCAGCGATGCAGTGTTGAATTTGTTCCGCAGCATT
GTTGATGATTTTGGGCAGTCACTTGTGTTTGTCACCCACGATAAAGATGCTGCTCACCGT
GGTGACGTGTTGATCACAATGCGTGATGGCAAGATCATCGATACGGCAGATTTGCGGGTG
GGGCGT >RXN00410-downstream
TAATGTTCAGGCTTGCTTTCGCT
```

Appendix A, page 81

Attorney Docket No.: BGI-125CP

>RXN00411-upstream
CATTTGGCAAAATGACTGTTCGACTCACCGGCAACACCGCTGCGATTGAAGAGTTCTATC
AAACCTTGACCAAGACCACGACCATCAAGGAGATCACCCG >RXN00411
ATGAACGAGATGATCCTCGCAGCTGACTGGAACCGGCTAGGACCCACCTTCCAAACAGCC
ATCATTGACACCCTGTTGATGGTCATCATCACCATGGTGGTGGCTGGCTTACTGGGTCTT
GTCGTCGGCCTGCTGCTTTACACCACCCGCGCTGGTGGAATCTTGAAGAACAAGGTCATC
TACACCATTTTGAATGTGCTGGTGAACTTTGTTCGACCCATCCCATTCATTATTTTGATC
GCCGCCATCAAGCCACTAACGGTCGCCGTCATGGGCACCTCCATCGGCCGAGATGCCGGC
ATCTTCGTCATGGTTGTCGCAGCGATTTTCTCTGTGGCTCGAATCGTGGAGCAAAACTTG
GTCTCCATTGATCCTGGTGTCATCGAGGCAGCTCGCTCCATGGGTGCGTCCCCGATGCGC
ATCATCGCCACCGTGATCATTCCAGAAGCACTTGGACCATTGGTTCTGGGTTACACCTTC
CTGTTCATCGCGATCGTCGATATGTCCGCAATGGTCGGCTACATCGGTGGCGGTGGTCTT
GGTGACTTCGCCATTGTTTACGGCTACCGCGCCTTCGACAACGAAGTTATGTACGTTGCC
GTCCTGGTTATCGTCATCATCGTGCAGGCAGCCCAGCTTCTGGGCAATTGGCTGTCCAAG
AAGATCATGCGCCGC >RXN00411-downstream
TAAACCTCTTGCATAGAAAAACC >RXN00412-upstream
CTTTTGACGAACACCACGTCGCGTACGCTTCCTCGGGGCGTTAAACTATTTGTCTTCCAG
CTTTTGTCCCCGACTTTTGTACGAATCGAGGACACCGTC >RXN00412
GTGTCACACACCGCGTCCACACCGACGCCAGAGGAATACTCCGCGCAGCAACCCAGCACC
CAGGGCACTCGCGTTGAGTTCCGCGGCATAACCAAAGTCTTTAGCAACAATAAATCTGCT
AAAACCACCGCGCTTGATAATGTCACTCTCACCGTAGAACCCGGTGAGGTAATCGGCATC
ATCGGTTACTCTGGCGCCGGCAAGTCCACTCTTGTCCGCCTCATCAATGGCCTTGACTCC
CCCACGAGCGGTTCGTTGCTGCTCAACGGCACCGACATCGTCGGAATGCCCGAGTCTAAG
CTGCGTAAACTGCGCAGTAATATCGGCATGATTTTCCAGCAGTTCAACCTGTTCCAGTCG
CGTACTGCGGCTGGAAATGTGGAGTACCCGCTGGAAGTTGCCAAGATGGACAAGGCAGCT
CGTAAAGCTCGCGTGCAAGAAATGCTCGAGTTCGTCGGCCTGGGCGACAAAGGCAAAAAC
TACCCCGAGCAGCTGTCGGGCGGCCAGAAGCAGCGCGTCGGCATTGCCCGTGCACTGGCC
ACCAATCCAACGCTTTGCTTGCCGACGAAGCCACCTCCGCTTTGGACCCAGAAACCACC
CATGAAGTTCTGGAGCTGCTGCGCAAGGTAAACCGCGAACTGGGCATCACCATCGTTGTG
ATCACCCACGAAATGGAAGTTGTGCGTTCCATCGCAGACAAGGTTGCTGTGATGGAATCC
GGCAAAGTTGTGGAATACGGCAGCGTCTACGAGGTGTTCTCCAATCCACAAACACAGGTT
GCTCAAAAGTTCGTGGCCACCGCGCTGCGTAACACCCCAGACCAAGTGGAATCGGAAGAT
CTGCTTAGCCATGAGGGACGTCTGTTCACCATTGATCTGACTGAAACGTCCGGCTTCTTT
GCAGCAACCGCTCGTGCTGCCGAACAAGGTGCTTTTGTCAACATCGTTCACGGTGGCGTG
ACCACCTTGCAACGCCAATCATTTGGCAAAATGACTGTTCGACTCACCGGCAACACCGCT
GCGATTGAAGAGTTCTATCAAACCTTGACCAAGACCACGACCATCAAGGAGATCACCCGA >RXN00412-downstream
TGAACGAGATGATCCTCGCAGCT >RXN00419-upstream
GCTGGTTGAAGACTCGAAATGAGATCGACCCAACCGGAGTCTTTGCATCTGACATGTCCC
GCCGACTTGAGCTTTCTTAAGAAAGGGCTTGAACTAAACA >RXN00419
ATGCTTAACGCAGTGGGCAAAGCCCAAAACATTCTCCTTCTTGGTGGAACCTCTGAGATC
GGTATTTCCATTGTCTCCCGCTTCCTCAAGCAGGGTCCATCCCATGTGACCTTGGCAGCG
CGTAAAGATTCCCCACGCGTGGACGCAGCAGTCGCAGAGATCAAAGCAGCTGGCGCTGCT
TCCGTTGCTGTTGTTGATTTCGATGCGCTCGACACCGAATCCCACCCTGCAGCCATCGAC
GCAGCCTTTGAAAACGGCGACGTTGACGTAGCAATCGTGGCTTTCGGCATCCTCGGCGAC
AACGAAGCACAGTGGCGCGACCAAGCACTAGCAGTGGAAGCAACCACCGTGAACTACACC Appendix A, page 82

Attorney Docket No.: BGI-125CP

```
GCCGGCGTTTCCGTAGGTGTACTGCTGGGCCAGAAATTTGAGCAGCAGGGCCACGGCACC
ATCGTGGCATTGTCCTCTGTGGCAGGCCAGCGAGTCCGCCGCTCCAACTTTGTCTACGGC
TCCGCCAAGGCAGGTTTCGACGGTTTCTACACCCAGCTCGGCGAAGCCCTGCGTGGATCC
GGTGCCAACGTATTGGTGGTTCGCCCAGGCCAGGTACGCACCAAGATGTCCGCAGATGGT
GGCGAAGCCCCACTGACCGTCAACCGCGAAGACGTGGCAGATGCTGTTTATGATGCAGTG
GTGAACAAGAAGGACATCATCTTTGTCCACCCACTGTTCCAGTACGTCTCTTTTGCGTTC
CAATTCATTCCGCGAGCAATCTTCCGCAAGCTGCCGTTC

>RXN00419-downstream
TAACGGAAGTTACGGAAGTTACG

>RXN00432-upstream
AGCTAATCTGCCTTGCTTTACACCTCCGGGCTATAACAATCCAGTGCCAGTGGCTAGGGA
TTTACTAAAAATCGGGTAACACGCGCGTAGTATTTTTCGC >RXN00432
ATGGAATTATTGGAGACCTTCATCACTGATGTCATTAATGACAATTTGTGGATGATCTTG
CCCTTCTTGCTCGTTGCTGCTGGCCTCTATTTCGGTGGGCGTACGTTGCTGGTTCAGATT
CGGATGATTCCGGAGATGTTCAAAGCGGTCGTCGAGAAGCCTGCGAAGGATGGGGAGTTC
GCGGACAAGCAGGACATTTCGGCTTTTAAGGCGTTCACGATTTCTGCGGCGTCGCGAGTT
GGTACGGCGAATGTTGCGGGTGTTGCGCTGGCGATCACTCTGGGTGGACCGGGTGCAGTG
TTCTGGATGTGGATCATTGCGCTGGTTGGCGGTGCGACATCGTTCATTGAGTCGACTCTT
GGACAGTTGTGGAAGGTGAAGGACGGCGACAGCTATCGCGGTGGCCCTGCGTACTACATG
ACGCTTGGTTTGAATGCTCGGTGGCTTGCGGTTGTTTTCGGTGTCGCCATCACGTTGACC
TTTGGTTTTGTGTACAACGCTTTGCAGTCCAACGCGGTTGTTGAGGCGATTACGGTATCA
CTCGGCACCCCTTCTACCACTGCAAAGGCTTTTGTTGGCTTGGGCATGGCTGGATTGTCT
GCGCTGGTTATTTTTGGCGGCGTGCAGCGTATCGCAAACGTGACGCAGTGGATGGTTCCG
TTCATGGCGGGTGCGTACATCATTGTGGGTGTGGTGGTGATTGTGATTAACATTCAGCAG
GTTCCGACCATGATCAACGACATCATTGCTGGTGCTTTTGGTTTCCGTCCGGTTGCTACT
GCGTCGGTGTGGGGCGCGTTCTGGTTGGCGTTTATGAACGGTATGCGCCGTGGACTGTTC
TCCAATGAGGCTGGTGAGGGTTCTGTCCCGAACGCTGCTGCTACCGCGACTGTGTCTCAC
CCTGTGAAGCAGGGTTTGGTTCAGACTCTGGGCGTATATTTCGACACCCTGCTCGTTTGT
AGCATTACCGCTTTTGTCATCCTGCTGTCTGGAGTGGAGTACGCGACCGGCGATATTCAG
TCTTCTTCTTTGACTCAGTCCGCGCTGGCTAGCGTTGTTGGTGGTTGGGGAACCCACTTC
ATTACCGTAGTGATGTTCTTCCTGGCGTTTTCTTCCGTGCTGGGTAACTACTACTTGGCA
CAGGCGAATATTCAGTACTTCACCGATTCGAAGACTGTCATGACTGTTTTCCGACTCTTG
GTGCTGCTCAGCGTGTTCTCTGGCGCGGTTGCTTCGGTGCCGTTGATCTGGGCTTTGGGT
GATACTTTCGCTGGCATCATGGTGCTCATTAACCTGGCGGCGATCATTCCGCTGGGTGGC
GTTGCAGTGAAGTTGCTTAAGAATTACACCATTCAGAAGAAGGCTGGTCTGGATCCTGTG
TTCCACCGCGACATGATGCCAGAGGTTCGTAATATTGCGTGCTGGAACGGCAAAGATGCA
GCTACATCCAACTATCACGAAGCGATGGAAGTGATCAAGAAGAGC >RXN00432-downstream
TAGTCATCGAAGGAACAGTGGTA >RXN00443-upstream
TAAACAAGGAGCGTTTAATTTCCACCCAATCCCACTGAAAGTTTCCCACCCCACAGTTAT
GCTGATTAAGTACTGAACTTACCGTAGGAAAGGCACTCAG >RXN00443
GTGAACAAAAGTATCCGTCGAGCTCTCTACAGTTTCATCACTATTTCGGCGGGTATCTCA
CTCGTAGCGTGCTCTTCTTCAGACACCGCAAGCACTACCACCCAGAATGCCTCTGCTACC
GAAGCAGCTGGGGTTTCCGGAACCGCTAGCGTTTTCGCTGCGGCGTCTTTGACCAACGTT
GCTGAGGATCTCGCGGCTGCGTTCAACGAAGACAATCCTGATGCAAAGTTGGAGTTTAAC
TTCGCTGGTTCTTCCGCGCTGGTTCGCCAGATCAGCGAAGGCGCACCATCTGATCTGTTC
ATTTCTGCGGACATCGCCAACATGGACGATGCGCTGGCACTTCCAGAATTTGCCGGCGCA
ACCTCGAAGGTCATCGCTACCAACAAGCTGGTGCTGGTCACCGCAGACGGCAACCCCGGC
GAAATTTCAGAGCTTGCCGACGTCAAGGACTCCCTCGTTGCTATCTGCGCCCCTGAAGTT
CCATGTGGAACCATCACCCACGAGGCTTTGGACTACGCAGACATCGAGTTGAACACCAGC
TCTGAGGAAGCCAATGTTGCTGATGTCGCCACGAAGATTTCCACCGGTGCAGTTGATGCG
GGCTTTGTTTACCAAACCGACGCTCAGTCTTTGGCTAAAACTCAGGACAACACTGTCATT
```

Appendix A, page 83

Atty Docket No.: BGI-125CP

```
GAACTCGAAGGTATCGACGCCAACGAATACCCAATGGCATTGACCACCACCGGTGAAGAC
AACGAGGTAGCGAAGGCTTTCGCAGAGTTCCTCAGCAGCGATCGTGCCAAGGAGATCCTT
GCCAGCTATGGTTTTGGCACAAAC
```

>RXN00443-downstream
```
TAAAAAGGCTCGTCGAAGCGAGA
```

>RXN00444-upstream
```
TACCCAATGGCATTGACCACCACCGGTGAAGACAACGAGGTAGCGAAGGCTTTCGCAGAG
TTCCTCAGCAGCGATCGTGCCAAGGAGATCCTTGCCAGCT
```

>RXN00444
```
ATGGTTTTGGCACAAACTAAAAAGGCTCGTCGAAGCGAGAATCATATCCTCCCAGGGTGG
TTGCTCATCCCAGCCACCCTGGCCATGCTGCTGATCATTGGACCTATTTTTGCTTTGCTG
TTGCAGATCCCCTGGGATCGGTCTTGGGAGTTGCTTACCGCGCCGGAATCTTTAGGAACC
GCACGGTTATCTATCGGAACTGCTCTGTTTTCTACCGCGCTATGCGCAATTGTGGGTTTC
CCGCTAGCGTTGGCGCTGCATTTATATGAGCGTTCGCACCCCAGGGTGACATCAGTTTTG
ACGGTGCTGGTTTATGCGCCTTTGGTGTTGTCGCCGGTGGTGTCTGGTTTGGCGCTGACT
TTTCTGTGGGGCAGGCGTGGTTTTTTAGGTTCTTGGCTTGATCAGGTTGGATTGCCGATT
GCATTTACCACCACGGCTGTGGTGTTTGCCCAGGTGTTTGTAGCGTTGCCATTTTTCATT
TCCACTGTGACTACTGCACTGCGTGGCATTCCAAAACAGTTTGAGGAAATCGCAGCTACT
GAAGGCGCAACCCGCTGGGAGATCATGCACAAGATGATCATTCCGCTGGCGATGCCTGGA
ATTTTCACCGGTATGATTTTGGGATTCGCCAGGGCCTTGGGCGAGTATGGTGCGACACTG
ACTTTTGCTGGAAATATTGCAGGTGTTACCCGCACCATTCCGTTGCATATTGAGCTTGGT
TTGAGTTCCAATGACATGGATAAAGCCTTGGGAGCGGTGATTATGCTTTTGGCTGTCTAT
GTCCTCATCATTGGAGCCATCGGAGCGTTACGATTGTTTTCCAAGGTGAGAAAGGTT
```

>RXN00444-downstream
```
TAATTGATGTCTCGTTCGCCGGA
```

>RXN00449-upstream
```
TCGTTGGCTTACATGGTCATTGATGACCGGGCTGAATATGTGAGAAAATCCATCCCTTCT
TTAAGCAAGGGAGTGAATTACAGAAAAGGATTGTTCAGCA
```

>RXN00449
```
ATGAGCACACCTGACATTAAAGAAGGCTCGGCAGAATCACCGGGCGAAGTAATGGTCGTT
GGAGACAGGCGAGAGTGGCGTCGACAAGCAACCGGCATCATTGCCGGCCTCGTCTTAGCC
GCCCTGGTCTATCTTCTCTTCCCCTCGAACTCCGTGGAAACCGTCATGCAATCCAGTGGC
GTCGATCCAGAAACTGAATACACCAACAACGCGATGCGTCTTACTGCTGCAGTCACAATC
TTGATGGCAGTGTGGTGGATGACAGAAGCAATCCCACTAGCAGCAACCGCACTTATCCCG
TTGGTTGCATTCCCTGCTTTCCAGGTTGTGGACTTTGGGAAGGCAACAGCTCCGTATGCC
AACCCTACGAGCTTCCTCTTCTTGGGCGGCTTTCTTATGGCACTTGGCCTGCAGAAATGG
AACCTACACCGACGTATGGCTCTAGCGGTCGTGCTAGCTGTTGGTACTAAGCCAAAGCAA
TTGGTCTTGGGTTTTATGGTGGCAACTGGATTTTTGTCCATGTGGGTGTCTAACACTGCA
ACGGCCGTGGTTATGTTACCGATCGGTATGTCGGTACTGGCACTGACCGCTGAGACTGTG
GGCGGAATGAAAAACCAAAAGAAATTCGCCACTGGACTCATGCTGTCCATTGCTTATTCT
GCTTCCATCGGTTCACTCGGCACCTTAATTGGCACGCCACCCAATGCCTTGCTTGCTGCG
TATATGTCTGAATCGCATGATATCCACATCGGATTTGGTCAGTGGATGATTCTTGGTGTA
CCAATTGCTGTCGTCTTCACCATCGCGTGGCTTGTGTTGACCACCGTGTTCAAGCCA
GAAATGAAAGAAATCCCTGGCGGACGTGAACTGATCAAACGTGAAATCGCTGAAATGGGG
CCGTGGACTGCACCTCAGGTCACAGTGGGTGTTATTTTTGCGGCAGCTGCACTGGCTTGG
GTCTTCATTCCATTAACTCTAGATTGGACCGGTTCCCAGCTCTCTATCAATGACTCCCTC
ATTGGCATCGCTGCCGGCCTGCTGATGTTTATCGTTCCCGCTAACTTTAAAACCGGCGAA
CGCATTCTTGATTGGCGTACTGCAGGCGAACTTCCATGGGATGTTCTCTTGCTTTTTGGT
GGCGGGCTTTCACTTTCTGCGATGTTTACCAGCACGGGACTTTCCCTATGGATCGGTGAA
CTAGCTAAGGGACTTGATGCCCTTCCAATCTTCATTCTCATCTTCGCCATTGCTGTCCTG
GTGTTGTTCCTGACCGAGTTCACCTCCAACACCGCAACAGCGGCAACCTTCCTGCCAATC
ATGGGTGGCGTCGCCGTAGGTATCGGACTGACCGCAGGTGGCGAGCAGAATGTTCTGCTG
CTGACCATCCCAGTCGCACTGTCCGCAACCTGTGCGTTCATGCTTCCAGTGGCAACGCCT
CCAAACGCGATTGCATTCGGCTCCGGCTACATTAAGATCGGCGAAATGGTCAAGGGTGGT
CTGTGGCTGAACATCATCGCAGTCATCCTCATTACGATTTTCACCTACTTCGTAGCGATC
```

Appendix A, page 84

Attorney Docket No.: BGI-125CP

CCACTCTTTGGCATCATGCTT

>RXN00449-downstream
TAAAAGTTAACAGGCCCGCAGTC

>RXN00456-upstream
CTCACCAACCCGGAGATCGTCACAGCGGTGCTAACGGATCATGCCTAGCTTATGGCGTGC
TCGTCGCAGACTTTTGCTCATTGCCCTAGGTGTACTTGGT >RXN00456
GTGCTGCAGGCACTGCTGGCGATCATGGTGTCGTTGAGCGTAGCCGCCATACTTGAGGGA
AACCGAGCACTTGTTGGATTGCTGCTTGCTACCACGTTGGGTTTGGGGGTGGCGCAGTGG
ATTCAAAAAGTAGTGGCAGAAGATCTAGGCCAGCATTATGTGCATGAGGTGCGTCGTGAA
TTGGTGGGTGCTGCGCTGGTGCCTGGAAATACGGCCTCGTTGGGCGTGACTGTCACCCGA
GCCAGCAATGATCTCACCGCGGTGCGCAATTGGGTGGCTTTGGGCATTGTTCCGATGGTC
ACCGGGCTGCCGTTGATTGCGATTGTGCTGGTGGCGTTGTTTATCCAAGATCTCCGCACA
GGCGTGGCTGTTACTGTGCCACTGCTCATGTGTGTAGCCGTGCTGCCGGTGGTGGCGCGG
TGGACTTTGAAAAGAGCACGTGAACTACGCAAAAAACGTGGACGCATGGCTGCGCGGATC
GCAGATTCTGTCATGGCTGGAGAATTACTGCACGCAACAGGAGCAATAGACCGTGAGCTC
AATGCAGTCACCCGAGATTCCGACCGAGTGGTGATAGCTGCTGTAAGACGTTCCTGGGCC
ACCGGTTTTAGCCGCGCATTGATGGCCATGGCAGCCTCGCTTGGCACTGTCAGCATTGTG
ATTTCTGGCCACCTGGAAGTAAGTGAGGTTGCGGGAATAATGATGCTTCTTGGCGTTCTT
GCCACTCCAGTTGCAGAACTTGGCCGCGTGGTGGAATATCGCCAAAATTATAAAGCCGCG
ACACGCATCCTGATTCCACTTCTGCAACGAGGCTCAGAATTTAAACACTCCCAACAAAAA
CTACCCGGGTTGCAAGCAACAGAAGGAATCCCCGGTGTCTATGTCAAAGGTATTTCCGCC
CTTCCTGGAGAACGGATCTACCTCCACGGCTCTGCAGATGCGACGAGAAAATGGGTCACC
TCGTTGTCTGCAATGGAGGAAGGCACAGATGTAATAGTCAACGGTCAAAGGCTTTCGCAG
CTTCCTTTGAAACAACGACGCGCCCTCATCGGAATCGCCTCAGCACACCACCACTTAAGC
CGTGGTTCAGTATCGCGCCTGGTTGGTTTGCGAGTGCCGGATGCCACCGTGGAAGAAATT
GAGCAAGCACTGGAACAAGTTGGTCTGAACAACACCGGGAAACAACGCTTGAAAAACGGC
GGACACCCCTGGAGTACTTCGCAGATCAACAAACTGAAAATTGCCAGCGCCACCCTTCGA
ACCCCACCGCTTTTGGTACTTGAAGGCATCACCCCTGAAAACCTCCTCAACTATCCCGGA
GTGATCATCTCCACCGTTCAGGAGAACCCATCCGAAACATGGCGGCAAGTGAACATC >RXN00456-downstream
TAATCTAGAAACATGGCAGGACG >RXN00466-upstream
TTTAAAAGCGCACTAAGAGCTCGTCAATTCTTTAAAACAAGCTGAGAATGTGAATAATAG
GATAGGTTAACCTGATTCGATTAGAAAACGGAGATTTGTC >RXN00466
GTGCAATCCCGCCTGTCCAAAATCCTGCGCAGTAGCGTCGTAGGCGTTGCTGTCCTAGCC
CTGTTAGCTGGGTGTTCTAACAATGCAGATGACACCGACGCTGATTCAACATCCACGGGA
AACTCCGCTTTTCCTGTTTCGATTGAACACGAGTTCGGAACCACCACAATCGATGATGTA
CCCGAAAGAGTTGTCACCCTTGGCGTTACCGACGCCGATATTGTCCTCGCATTGGGGACC
GTCCCAGTAGGCAACACCGGATACAAATTCTTCGAAAACGGATTGGGACCGTGGACTGAT
GAGTTAGTGGAAGGCAAAGAATTAACACTGCTTGACTCTGATTCCACACCAGATCTTGAA
CAAGTAGCAGCCCTGGAGCCAGACCTGATTATTGGAGTCTCTGCGGGGTTTGACGACGTT
GTATACGAGCAACTATCTGATATCGCACCGGTGGTCGCCCGTCCAGCGGGAACAGCTGCA
TACGCAGTAGCTCGCGAGGAAGCTACCAACCTTGTTGCCCGTGCGATGGGGCAATCAGAA
AAAGGACAAGAGCTCAATGAGGAAACAGATGCTCTGATCCAAGCTGCGCGTGATGAAAAT
CCTTCTTTTGACGGTAAAACAGGAACCGTCATCTTGCCATACCAGGGTAAATACGGTGCC
TACCTGCCAGGCGATGCACGGGGACAATTCCTCGATTCACTTGGCATTTCGCTGCCGGAA
GCAGTTCTTTCGCGAGACACCGGCGACAGCTTCTTTGTCGATGTCCCCGCTGAAAGCGTC
AAAGACGTAGACGGTGATGTTCTCCTCGTGCTTTCCAACGACGAAAATCTGGATATCACA
GCAGAGAATCCACTGTTTGAAACACTCAACGTTGTGCAAAAAGACGCAGTAATTGTGGCA
ACAACCGAAGAACGCGGGGCGATTACCTACAACTCAGTGCTGTCTGTTCCTTTTGCGTTG
GAACATCTCGCACCACGTATTGCTGAGGCTTTGAAG >RXN00466-downstream Appendix A, page 85

Attorney Docket No.: BGI-125CP

TAAAACTCAACTACTCGAGCACA

>RXN00477-upstream
TGCGGGAGCGAATCAGAGTTCCACTTCATATCAAACTCTCTACACTCGCTAGAGCCACGA
TGAAAGGTCTATCTATGAGCATCTACAGAAAGAATTCGTG >RXN00477
ATGAAGGTCTCGACTAAAACTCCACGCTCCTCAGGTACCGCCGTAGTCATAGGCGCAGGT
GTTGCTGGTTTAGCCACTTCTGCACTTTTAGCACGTGATGGCTGGCAAGTAACTGTTTTG
GAAAAAAATACTGATGTCGGTGGCCGAGCTGGATCGCTTGAAATATCAGGCTTTCCTGGC
TTTCGATGGGATACCGGACCTTCTTGGTACCTCATGCCCGAGGCCTTTGACCATTTCTTC
GCACTTTTTGGTGCATGTACTTCTGATTATCTCGATTTGGTAGAATTAACGCCTGGTTAT
CGAGTTTTTCTGGCACACATGACGCTGTCGATGTCCCCACTGGGCGTGAAGAAGCAATT
GCGCTATTCGAATCCATCGAACCCGGCGCGGGTGCAAAACTAGGAAATTATCTTGATAGC
GCGGCAGACGCCTATGACATTGCCATTGATAGATTCCTTTATAATAATTTCTCCACGTTA
GGCCCGCTGCTTCACCGGGATGTACTGACCCGAGCTGGCCGACTGTTTTCTCTACTGACC
CGTTCTTTACAAAAGTACGTAAATAGTCAATTCAGTAGCCCGGTGTTGCGCCAGATCCTA
ACCTATCCAGCAGTCTTCCTGTCTTCCCGACCCACTACTACCCCATCGATGTACCACTTG
ATGAGTCATACCGATTTGGTGCAGGGAGTGAAATACCCTATAGGTGGTTTTACTGCAGTG
GTTAACGCTCTGCATCAGTTAGCGCTGGAAAACGGGGTTGAGTTTCAACTCGATTCTGAG
GTCATTTCCATCAACACTGCTTCATCGAGGGGCAACACAAGCGCCACAGGTGTGAGCTTG
CTTCACAACAGAAAAGTGCAAAATCTAGATGCGGATCTTGTGGTTTCAGCAGGCGACCTA
CACCATACAGAAAATAATCTGCTTCCCGGGAACTTCGAACCTATCCCGAACGATATTGG
TCCAATCGCAATCCTGGAATTGGAGCGGTATTAATCCTCCTGGGCGTAAAAGGAGAGTTA
CCCCAGCTCGACCATCACAACCTTTTCTTCAGTGAAGATTGGACAGATGATTTTGCTGTA
GTTTTCGACGGGCCTCAACTTACCCGCCCCCACAATGCATCAAATTCCATTTATGTCTCC
AAGCCTTCAACGTCCGAAGACGGCGTTGCACCTGCTGGATACGAAAACCTTTTTGTTTTA
ATTCCGACCAAGGCCTCTAGCAGCATCGGCCACGGTGATGCGTATATGCAGTCGGCTTCA
GCATCCGTGGAAACAATCGCGTCACATGCAATCAATCAAATTGCTACGCAAGCCGGCATC
CCTGACCTCACTGACCGAATTGTGGTCAAACGCACCATTGGCCCTGCGGATTTTGAGCAC
GCTACCATTCATGGGTAGGCAGTGCGCTGGGTCCAGCACATACCCTCAGACAGTCCGCT
TTCTTAAGAGGGCGCAATAGCTCCCGCAAGGTCAATAACCTCTTCTATTCCGGTGCCACC
ACCGTCCCGGGTGTAGGAATACCCATGTGTTTAATTTCTGCCGAGAATATTATTAAGCGT
TTACATGCCGATACCAGTGCAGGACCACTGCCCGAACCATTGCCGCCTAAAACGACACCA
TCTCAAAAGACCTCATACGATCAT >RXN00477-downstream
TAAATTTTGATCCCTATCATCGA >RXN00523-upstream
TGGTGACTCGTCCGAGTGAAATTGCCGTGGGCATCATCATGCCGATCATTGGTGCGCCAC
TGTTTATTTGGATTATTCGTCGTCAGAAAGTCAAAGAGCT >RXN00523
ATGAGCCTTAGCCATCAACTCAAGCGCCAGCGCGGCATCGCGCAACTCCCGCAGGTGGCTG
ATTGTTGCGGCATTGGGCGTCGTCACGCTTGGTATTTTTGCTTTTTCTTTGATGTGGGGC
GAGGTGTTTTATGGCCCTGCTCAGGTGCTGAAAGTGTTGTCTGGACAGCAGGTTCCCGGC
GCGAGTTATTCCGTTGGCGTGTTGCGTTTGCCGCGCGCGGTGATGGGTTTGACTGCGGGT
TTGGCGTTTGGCGCGGCGGGCGTGATTTTTCAGACGGTGTTGCGTAATCAGTTGGCGTCG
CCGGATATTATCGGCATTTCTTCTGGCGCGTCGGCGGCGGGCGTAATTTGCATTGTGTTT
TTCGGGATGTCGCAGTCTGCAGTGTCGGCGATTCTTTGTGTGCGTCCTTGGCTGTGGCG
TTGTTGATTTATCTGGTGGCGTATCGCGGTGGTTTTTCGGCCACGCGTCTGATTCTTACC
GGCATTGGTATTGCTGCGATGCTGAATTCATTAGTGTCGTATTCGCTGTCCAAGGCTGAT
TCTTGGGATCTGCCGACCGCGACGCGCTGGCTTACCGGCTCGCTCAATGGTGCGACGTGG
GATCGTGCGATGCCGCTGATTGTCACCACTGTGGTACTCATTCCGCTGCTGGTGGCTAAT
GCGCGCAATGTGGATCTTATGCGTTTGGGCAATGATTCCGCGGTGGGTTTGGGCGTTGCT
ACTAATCGCACGCGCGTCATTGCGATTATTGCCGCTGTTGCGCTCATCGCCGTTGCTACC
GCTGCATGCGGCCCGATCGCATTCGTGGCGTTTGTGTCTGGCCCCATTGCCGCGCGCATT
TTAGGCTCCGGCGGATCGCTCATCATCCCTCCGCACTCATCGGCGGGTTGATCGTGCTC
ATCGCCGACCTAATTGGCCAATACTTCCTCGGCACCCGCTACCCCGTCGGAGTTGTCACC Appendix A, page 86

Attorney Docket No.: BGI-125CP

```
GGCGCATTCGGCGCCCCATTCCTTATCTATTTACTCATTCGTTCCAACCGCGCGGGAGTA
ACCCTG

>RXN00523-downstream
TGACCACCAACCATCAACTATCC

>RXN00525-upstream
CCATCGTGTTTATTACTCACAACCCTGAGCTTGCTGATGAATCTGATCGGGTGGTCACCA
TGGTTGACGGGCGCATCATTGGGTCTGAGGTGAAACACTC >RXN00525
ATGAGCCTTGCAGAATCAATTCTTTTGGCGCTCACCAGCCTGAGAAGCAACAAGATGCGT
GCATTGTTGACGCTGTTAGGAGTCATCATTGGTATCGCATCAGTCATCGGAATTTTGACC
ATTGGTAAAGCCCTGCAGGATCAAACTTTGAATAGTTTGGAAAGCTTGGGCGCGAATGAT
CTGTCGGCGCAGGTGGAGGAACGCCCCGACGAAGATTCCCCCGAACCCGATATGTTCGCT
TTTTCTGGGGCTGCAAACTCTAGTGGCAATCTGATTCCGGAAGAAACAGTTGATACGCTG
CGCGATCGTTTCGCAGGCAGCATCACGGGAATCAGCGTTGGCGGAATGGGTACGCAAGGC
ACTCTCATCGGCGACACCGCAGATCTTAAATCCGATCTCCTCGGCGTCAACGAGGATTAT
ATGTGGATGAATGGCGTCGAAATGAACTACGGCCGCGCCATCACGCAAGACGATGTTGCC
GCTCAGCGCCCCGTTGCGGTCATCGCCCCAGACACCTTTAATACGCTTTTCGACGCAAAC
CCCAACCTCGCTCTGGGGTCCGAAGTAGCTTTTGAACTCAACGGTCAAGAGACATTTTTG
CGGGTTATCGGTGTGTATAAAGAAGCCGCAGCAGGTGGACTTGTGGGAAGCAATCCAACC
GTCCACACCTACACCCCATATACGGTGGCCAATGACATCACCCACACGGAAGATGGATTG
AACACGTTAAGTATCCGTGCAGCTCAGGGCGTAGACCAGGATTCACTTAAGGGTTCACTG
CAAACCTACTTCGACGCGCTGTACGCCAACAATGACTCGCACCACGTTGCCATGTTGGAC
TTCCGTAAACAGATCGAAGAGTTCAACACCATTCTCGGCGCAATGAGTTTGGGTATCTCA
GCCATCGGCGGAATTTCCTTGCTTGTCGGTGGCATCGGAGTGATGAACATTATGTTGGTG
TCTGTCACCGAGCGAACCCGCGAAATCGGTGTCCGAAAAGCCCTCGGCGCTCGTCGACGT
GACATTCGCCTGCAATTCGTCGTTGAAGCCATGATCATTTGTTTCATCGGTGGCATCCTC
GGCGTGCTTTTGGGCGGCATTTTGGGATTGATCATGTCCAGCGCTATTGGCTACATTTCC
TTGCCACCACTGAGTGGAATCGTGATCGCCTTGGTATTTTCCATGGCTATCGGCCTGTTT
TTCGGCTACTACCCCGCCAACAAGGCAGCAAAGCTCGATCCAATTGACGCCTTGCGTTAT
GAG >RXN00525-downstream
TAAAAGCCTCGTTTTTAAGGTAG >RXN00559-upstream
CCCTTCAATCCAGTCTTTGACGGCCAATACGGCTTGCCGGGTTTCCAGCGGATCAATCCT
CATGAAGCATCAGCCTAGTACGAACCGTTAAAGTGTCCAT >RXN00559
ATGTCTGATAATCCGCATGAGAATCCCCGTGAGAATCCACACCGCTCCCCAGAAGTCGTC
CTTCGTTTCATGGCTGCCCCTACTGACGTTTTGATGGCTGGTAGCCATGGCGTTGGCGGT
GGCCGAGTCCTGGAATGGATCGATAAGGCTGCTTATGCTTGTGCTACCCAGTGGTCTGGA
ACCTACTGTGTCACTGCTTATGTTGGTCACATTCACTTCACTCGCCCTATTCCCTCTGGC
CACATGGTCGAGGTGCGTTCCCGCATTGCGATGACTGGCCGTTCCTCCATGCACATCGTG
AATGAGGTGCTTTCTGCGGATCCTCGCGATGGCAACTACACCCGTGCGTGTGACTGCTTG
GTTATTTTCGTGGCGAAGGACACCGCAACTGGTCGCGCTACCCCAGTTCCTTCATTTACC
CCTAAGAATGAAGAAGAGCAGCGCGTGTTGGAAGCTGCTAACTCCCGCATCGGGCTGCGC
AAGGCTATTGAAGCGGAGATGGAAAAGCAGACGTACAACGGACCTTCTGAGGCCCCTCGT
TTGATTACCCGCTTCTTGGCTAAGCCAACAGATATCAACTGGGGTGGCAAGGTCCACGGT
GGCACTGCCATGGAATGGATCGATGAGGCGGGTGCTGCGTGCACCATGGAGTGGTCTGGT
AACCACACCGTTGCGGTTTATGCTGGTGGTATCCGCTTCTACCAGCCCATTCAGATCGGT
GACCTCATTGAGGTGGACGCCCGCATGATGCGTACCGATAAGCGTTCCATGCAGATGTCC
ATCCACGTCCGTGCCGGTGATGCTCACCGTGGCCGTGCTGAGCTAGAAACCGCTATTCAC
GCAACGGTGACCTACTTAGGAATTGATGTCGACGGAGAGCCTTTGCCTGCACCACAGTTT
GTGCCTCGTACCCCTGAGGATATCCAGTTGGCTGAGCATGCAAACATCCTGAGGGATCTG
CGTGCTGATTACACCCCAATGCCGCTGTTCCAGCGCAGGGTTCCACTGCAGATCGAC
```

Appendix A, page 87

Attorney Docket No.: BGI-125CP

>RXN00559-downstream
TAGTTAGACCCGAAAAAGCCCCC

>RXN00563
TTCTACAAGGATCTCTACGCACGTTCCGCACGCGGCACGGCAGCACTGTGGATCGTGGCG
GCTAACTTGAGCTCCTACTCAGACATCGACGCCATCATCAACTGGGTCGGATCCGAGCAG
ACCACCACCGTCAACGGCGCATCCAAGCTGGTCAAGCCCAGCTTTGGTCCCTACCTTGCTG
TTCCCATTCGCGGCACCTCGCGTGTCCGGATCCATGGCAGATGCAGGCCCACAGGCAGAA
TCCCAGATGCGACTTCTGCTCTGGTCTGTTGAGCGCCTCATCGCAGGTCTTGCGCCATTG
GGCTCCTCCATCAACGTGGGTCACCGCCTGCACGTGGTCATCCCAGGTTCACCAAACCGT
GGACGCTTCGGTGGCGATGGTGCATACGGTGAATCCAAGGCAGCTCTCGACGCCGTGGTT
ACCCGTTGGAACGCAGAGCAAGCTGCATGGGGAGCACACACCTCCCTCGTGCACGCTCAC
ATCGGTTGGGTTCGCGGCACCGGCCTCATGGGCGGCAACGATCCTTTGGTCAAGGCAGCT
GAAGAAGCAGGCGTGGAAACCTACTCCACCCAAGAAATTGCAGAGAAACTGCTGTCCCAG
GCAACTTCCACTGTTCGCGAGCAGGCAGCATCCGCGCCAATCACCGTCGACTTCACTGGC
GGACTTGGTGAATCTGATCTGAACCTGGCCGGAAATGGCACGTGCAGAAGCAGCTAAGGCA
GCTAACGCACCAGTGGTTGAGGCTCCACGCACAGTGGCAGCACTGCCAACTCCTTACCGA
CCAGTGGTTCAAACCACCCCTGATTTCGCAGGTCAAGTCACCCAAAACCTTGACGAGATG
GTCGTCATCGTTGGCGCCGGCGAGCTCGGCCCACTGGGTTCTGCACGTACGCGTTTCGAC
GCCGAACTCAACGGTTCCCTCTCCGCGCGGGTGTCATCGAACTTGCATGGACGATGGGA
CTTATCCACTGGGATGAAGATCCAAAGCCAGGCTGGTACGACGACTCCGACGACGCAGTG
GCCGAAGAAGACATCTTCGACCGCTACCACGACGAAGTCATGGCACGCGTTGGTGTCCGC
AAGTACAATGACATGCCTGAGTACGGCATGATCGACAACTTTGCACCAGAGCTGACCACC
GTCTACCTCGACCAGGACCTCACCTTCAACGTGGGATCCCGCGAAGAGGCACTGACCTAC
GTCGACTCCGAGCCAGAACTCACCTTTGCTTCTTTCGACGAAGCAGCAGGGGAGTGGAAG
GTCACTCGCAAGGCAGGCTCCGCAATCCGCGTACCTCGCCGCATGGCGATGACCCGCTTC
GTTGGTGGACAGGTTCCTAAGGACTTCGACCCAGCTGTGTGGGGCATTCCAGCTGACATG
GTGGACAACCTGGACACCGTCGCGCTGTGGAACATTGTCTGTACTGTCGACGCCTTCCTG
TCCGCTGGATTCACCCCAGCAGAGCTGCTTGCTTCCGTTCACCCAGCACGCGTGTCCTCT
ACCCAAGGCACCGGCATGGGCGGCATGGAATCCCTCCGTGGCATCTACGTCGACCGCATT
CTGGCAGAGCCACGCGCCAACGACGTTCTGCAGGAAGCACTGCCCAACGTTGTTGCAGCT
CACGTCATGCAGTCCTACGTCGGTGGCTACGGACAGATGATCCACCCAGTCGCAGCTTGT
GCAACCGCAGCTGTTTCTGTGGAAGAAGCACTGGACAAGATCCGCATCGGCAAGTCCGAC
TTCGTTGTCGCAGGTGGCTTCGATGCCCTGTCCGTTGAAGGCATCACCGGCTTCGGCGAC
ATGGCAGCAACCGCCGACTCCGCAGAGATGGAAGGCAAGGGAATTGAGCACCGCTTCTTC
TCCCGCGCCAACGACCGGCGCCGCGGTGGATTCATCGAATCCGAAGGTGGCGGAACCGTC
CTTCTGGCACGCGGATCACTCGCAGCTGACCTGGGCCTTCCAGTACTCGGTGTCATCGGA
TTCGCAGAGTCCTTTGCAGATGGTGCCCACACCTCCATCCCAGCCCCAGGCCTCGGTGCC
CTTGGTGCTGCTCGCGATGGTGTGGAATCTCGCCTTGCAGTAGCACTGCGTTCCGTCGGT
GTCTCTGCTGATGAGATCTCCATTATCTCCAAGCACGACACCTCCACCAACGCGAATGAT
CCAAACGAGTCCGACCTGCACGAGCGCATCGCATCCGCTATCGGTCGTGCAGACGGCAAC
CCGATGTACGTGATTTCCCAGAAGTCACTCACCGGACACGCCAAGGGTGGTGCAGCAGCA
TTCCAGATGATCGGTCTCACCCAGGTCCTCCGATCCGGACTGGTGCCAGCCAACCGCGCA
CTCGACTGCGTTGACCCAGTACTGTCCAAGCATTCCCACCTCGTCTGGCTGCGGCAAGCCA
CTAGACCTTCGTGCGAAGGCACCAAAGGCAGGTCTTGTTACCTCCCTTGGCTTCGGACAC
GTCTCCGCTCTGGTTGCGATTGTTCACCCAGACGCCTTCTATGAGGCAGTTCGTGTGGCA
CGTGGTGCTGAGGCAGCTGACGTATGGCGCGCATCCGCGATCGCTCGCGAAGAAGCAGGC
CTTCGTACCATCGTCGCCGGTATGCACGGTGGCGTACTGTACGAACGCCCAGTCGAGCGC
AACCTCGGTGTCCACGGAGACGCAGCTAAGGAAGTTGAAGCTGCAGTCCTCCTGGATTCC
CGCGCCCGCCTAGTTGACGGTGTCCTCCGCGCCGAAGGC

>RXN00563-downstream
TAGTTGGTTATTGCGTTGAGCCC

>RXN00570
ACGAGACCTCGGCCCCAAGAAATTGGCAACGGGCTTGTCGCACTGATTTTCTCCGCATCC
GGACCCATCGCAGTGATCCTGGCTGCTGCTGCAGCGGGAAACCTTTCGCCTGATCAAACA
TCTTCATGGATCTTCGGAGCATTTTTAGGCAACGGACTGCTCACGCTGTGGCTTACCTAT
ATGTACCGCAGCCCGCAGGCATACTTCTGGACGATTCCCGGAACCGTCATCGTGGGCGAC
TCACTTACCCACTTAAGTTTCGCTGAAGTTATCGGCGCATACCTTGTTACCGGCGTTGTG
GTGTTTGCGCTCGGATGGACCGGTCTCATCGGACGGATCATGGCGGTACTGCCACCAACC

Appendix A, page 88

ATCGTGATGGCCATGGTCGCAGGCATTTTCCTCCGCTTCGGACTCGACCTCATCGACGCC
AGCGTGACCGACCCGCTCATTGCACTTCCCATGGTCATAGTTTTTGTGGCATTGAGCATG
AGTCCCCGCTTGGCAAGCATCGCCCCACCCGTTGCAGTAGCCGCAGTAGTGGGAACCATC
GTTGCCATCGCATCCGGCAAACTAGCGTCCGGAATTCTAGACAACGGAATTATCTCCCGC
CCCGTCTTTACCGCCCCAGAATTTTCCTTCGCCGGCCATCATGGAACTCGTTGTTCCCTTG
GCGATCACCGTAGTCATTGTCCAAAACGGCCAAGGCGTCGCAGTGCTTAAAGCAGCAGGT
CACCGCCCCGGAGTAAACCTTGCCGCCGCGGCCTCCGGACTGTGGTCCCTACCCATGGCG
TTGATCGGCAACATCACCACCTGCCTCACCGGCCCCACCAACGCGCTGATCGTCGCCGGA
GCAAAATCACAC

>RXN00571
ACACTTGTTCCACAGGTTTACGAAATAGTGATCTACGGCGCTGTGCTGTCAGCTGTACAT
GAAGATCCAACCCAGATCGGTGCGCTCAGCCCAGCAGTCGCCGGCACCCTTGGTTCCTAC
GCCATGATCGGCGTGATGATCGGTGCTCTATCTGCAGGTGCCGTTGGTGACCGCCTTGGT
CGTCGCAAAGTTATGCTCACCGCAATCGTCTGGTTCTCTGTGGGCATGGCGCTGACCGCG
TTCGCGTCCTCGATTGCGCTGTTCGGTTTCTTGCGCTTCCTCACCGGACTTGGCGTGGGC
ATGATCGTTGCAACCGGCGGCGCAATCATCGCGGAGTTCGCTCCAGCGAATAGGCGCAAC
TTGTTCAACGCAATCGTGTACTCCGGTGTCCCAGCCGGTGGCGTGCTGGCTTCTATCCTT
GCACTGCTCTTTGAAGATGTCATCGGCTGGCGCGGACTCTTCCTCATCGGTGGATCCCCA
CTACTGTTCCTCCTGCCACTTGCATACTTCTTCCTCCCAGAGTCCCCGCGCTGGCTCACC
TCCCGCGGCCGTGCTGCGGACGCCAAAGCCCTCTGCGCACGCTATGGGCTGCCGACGGAG
GAATTTGTCGTCGAAAAGCAGCAGGAAACAAAGGGCACCGGATTCGCTGGAATTTTCTCC
TCCAAGTACCTCATGGGCACCATTCTCATCGGCGCAATGAGCTTCATCGGGCTGCTTTCG
ACCTACGGCCTGAACACCTGGTTGCCAAAGATCATGGAATCCAACGGCGCAACCTCACAT
GATTCCCTGTACTCCCTGCTGTTCCTCAACGGCGGCGCAGTGTTCGGTGGCCTCATCGCA
TCCTGGTTCGCTGACCGCATCGGCGCGAAGACCGTGATCACCTCCACCTTCGCTCTCGCC
GCGATCTGCCTCGGAGTCCTGCCAAACATCTCCTCCTGGCCAATGATGTACACCGCAATC
GCATTCGCAGGCGTCGGCGTCCTGGGCACCCAGGTTCTCACCTACGGCCTGACCTCGAAC
TTCTTCGGAACCGAATGCCGCGCAGCGGGAGTTGCATGGTGTGCAGGATTCGGCCGACTC
GGCGGAATCGTCGGACCAGCAATCGGTGGCCTGATCATCGGCGCAGGATTCGGACCAAGC
TCCGCATTCCTCATCTTCGCAGCAGCTGCCGCAATCGGCGCGGTCTGCACCTTGCTGATC
CCGCGCTCCCCAGCAGAAGTAGAGGTCAAGGTCGCGCAGGAACCACTTGCACGTGTC

>RXN00571-downstream
TAACCCCAATTAATTCGAAACAA

>RXN00590-upstream
TCTAAACTCACTCTCAACTCACCAAGATTGTTCAACAATCTGCGATTGGTGTGCAATCTA
CCCCAATCATTTTGAAAGCCCCCACGAAAGGAGCGCGACA >RXN00590
ATGGCCGACAACAAAAATGCCGATGACAGCCAGCTAGTCTCAGCCAGCACTGGAACCCCT
GGGCCTGGCGACATTGCAAAAGCCAATGCGCCATCCCTCAAGCAAGCTGCAGTAACCGCC
TCTGGCCGAAGCGCTCTGATGGGTGCCATCTTCCTCATGGCAACTTCTGCCATCGGCCCA
GGGTTCCTCACCCAAACCGCTGTCTTCACCAACCAGCTCGGCGCAGCTTTCGCATTTGCG
ATCCTGGTGTCGATCCTCATTGACATCGCGGTGCAGCTGAATGTGTGGCGCATCATCGGC
GTCTCTGAAATGCGCGCCCAAGAACTCGGCAACACGGTTATCCCAGGTTTTGGTTGGGTG
CTGGCCGTACTGGTCTGTATTGGCGGCGTAGTATTCAACATCGGCAACATCGCCGGTGGT
GGCCTTGGGCTTAACGCGCTGCTTGGCTGGGACGTCAAAGTTGGTGGCGTGATCACCGCG
GCCATCGCGATTGCGATCTTCTTGTTCAAGCGACTTGGTGCTGCTCTGGACAAATTCCTC
GTGGTCCTCGGCGTCGTGATGATCCTGCTCACCGTCTACGTGGCTTTCGTCTCCCAACCT
CCAGTTGGCTCGGCGCTGAAGAATGCAGTACTTCCTGACACCATCGACTGGCTTGTCATC
ACCACACTTGTGGGTGGAACCGTCGGTGGATACATCACTTACGCTGGCGCACACCGCATG
CTGGACTCCGGACGAACCGGCCCAACAACGTCAAAGCTGTTTCCAATTCCTCTATCACC
GGCATCCTGATCACTGGCCTCATGCGCGTGGTGCTCTTCCTCGCGGTTCTCGGTGTTGTC
GCAGGTGGCGTCACCCTATCCACCACGGGCAACCCAGCCGCGGAAGCATTCCAGCACGCT
GCAGGCGATATCGGACTACGCATCTTCGGCGCCGTGCTGTGGGCAGCGTCCATTCCTCA
GTCATCGGCGCCAGCTACACCCTCTGCAACCTTCCTGGTGGAAAACAAGCCAGAGAAGAAG
CGTCTGCAAAACTGGGTGACCATCATCTTCATCCTGATTTCTTGCTCCGTGTTCATCATG
CTCGGCACGGCACCAGCAATCCTCTTGGTCTTCGCCGGAGCATTCAACGGTTTGGTCCTC
CCCGTAGGCTTTACCCTGATGATCTACGTAGCGATCTTCCGCCAAAAA Attorney Docket No.: BGI-125CP >RXN00661-upstream
CGGATGCAAGAGAACCGTGGTTTCGCTGATTTTTGGCGAACCCGGAATTAAGGCCCCGAG
GATTACATGCTTTTAAATCCTTTGAAAAGGGGACAAGATC >RXN00661
ATGAATCCTATAACCGAATTATTAGACGCAACACTATGGATCGGCGGAGTTCCGATTCTG
TGGCGCGAAATCATCGGCAACGTTTTCGGATTATTTAGCGCGTGGGCAGGAATGCGACGC
ATCGTGTGGGCATGGCCCATCGGCATCATAGGCAACGCGCTGCTGTTCACAGTATTTATG
GGCGGCCTTTTCCACACTCCACAAAACCTCGATCTCTACGGCCAAGCGGGTCGCCAGATC
ATGTTCATCATCGTCAGTGGTTATGGCTGGTACCAATGGTCGGCCGCAAAACGTCGCGCA
CTCACCCCAGAAAATGCAGTAGCAGTGGTTCCTCGCTGGGCAAGCACCAAAGAACGCGCC
GGCATTGTGATTGCGGCGGTTGTGGGAACACTCAGCTTTGCCTGGATTTTCCAAGCACTC
GGCTCCTGGGGGCCATGGGCCGACGCGTGGATTTTCGTCGGCTCAATCCTGGCTACCTAC
GGAATGGCTCGCGGATGGACAGAGTTCTGGCTGATCTGGATCGCCGTCGACATAGTTGGC
GTTCCTCTACTTTTGACTGCTGGCTACTACCCATCCGCGGTGCTTTACCTGGTGTACGGT
GCGTTTGTCAGCTGGGGATTTGTCGTGTGGCTGCGGGTGCAAAAAGCAGACAAGGCTCGT
GCGCTGGAAGCTCAGGAGTCTGTGACAGTC >RXN00661-downstream
TGAAAAGCGTTTACTAAATAGAA >RXN00733-upstream
ACGGCGAGGTTGTCGGTATTGGAACGCACACGAATTTGCTGAACACGTGCGGTACCTACC
GTGAAATTGTTGAATCCCAAGAGACTGCGCAGGCGCAATC >RXN00733
ATGAGTAATACTGCAGGCCCCCGCGGGCGTTCCCATCAGGCAGACGCCGCGCCGAATCAA
AAGGCACAGAATTTCGGACCATCTGCCAAAAGGCTTTTCGGAATTCTAGGCCATGACCGT
AACACCTTAATTTTTGTTATCTTCCTAGCCGTCCTGAGCGTTGGACTTACCGTCTTGGGC
CCATGGTTGCTGGGTAAAGCCACCAACGTGGTGTTTGAAGGATTCCTATCTAAGCGCATG
CCCGGCTGGTGCGTCAAAGGAAGATATCATCGCGCAGTTGCAGGCTGCAGGTAAACATAAT
CAGGCTTCCATGATGGAAGACATGAACCTTGTTCCAGGCTCAGGCATTGATTTTGAAAAA
TTAGCCATGATCCTCGGACTGGTGATCGGTGCTTATCTCATCGGTAGCCTGTTGTCGTTG
TTCCAGGCGCGGATGCTCAACCGCATCGTGCAAAGTGCCATGCACCGGCTGCGCATGGAG
GTGGAGGAAAAAATCCACCGCCTACCGCTGAGCTATTTCGATTCCATCAAACGTGGTGAT
CTGCTTAGCCGTGTGACCAACGATGTGGATAATATCGGTCAATCCCTGCAACAAACCTTG
TCACAGGCGATCACTTCCCTACTGACCGTCATCGGTGTGTTGGTGATGATGTTTATCATC
TCCCCACTGCTCGCACTCGTGGCGCTGGTATCCATTCCGGTCACCATCGTGGTCACTGTG
GTGGTTGCGAGCCGTTCCCAGAAACTCTTTGCGGAACAGTGGAAGCAGACCGGTATTTTG
AATGCGCGCCTGGAGGAAACCTACTCTGGCCACGCCGTGGTTAAGGTTTTCGGACACCAA
AAGGATGTTCAAGAAGCATTCGAGGAAGAAAATCAAGCTTGTGTA >RXN00733-downstream
TAAGGCCAGCTTTGGTGCCCAGT >RXN00784-upstream
GTCACATCAGTTATCGCGCGGAATAGTTAGCGGGCGCATGTGGTTGGGATATATGAATAA
ATCTATTCCAACTACGCGTAAAACGAGGACGTTTAAAGCT >RXN00784
ATGTCTATTGAATTCTCCGCACCAGCAAAAATGAAAATCGAAGTGTGGAGCGACATCATG
TGCCCCTTCTGCTACATCGGCAAAAAGCGCCTCGACGACGCCCTAAGTACCTTTGACCAG
GCCGGACGCATCGAAGTGGAATACAAGAGCTTCGAACTCATGCCAGGCCTAGAAACCCAC
CCACTGCGTTCCGACGTTGAATACCTCGCCGACGCCAAGGGCATGAGCCTCGAGCAGGCC
CGCCAAATGAACGGCCAAGTCCAAGCAATGGCACAAGCCACCGGACTTGAAATGAATCCT
GACGAAACCATCGCGGCCAACACCATCAACGCGCACCGCCTTACCCACTTCGCGAAAGCC
CACGGCAAGCAACAAGAAGTGGCGCAGGAACTCTTCAAGGCTCACTTCGTAGACGGCAAG
AACGTTGATGACCTCGATGTGCTGGTCTCCATTGCTGCAGAGGTTGGTCTCGATGCCAGT
GCAGCCCGCGAAGCTCTCGAATCCGACGTGTACACCAACGAAGTCCAACAAGACGTCCAC
GAAGCCCGCCAACTCGGCGTCCAAGGTGTGCCCTTCTTTGTATTCGACCGCAAATACGCC Appendix A, page 90

Attorney Docket No.: BGI-125CP

```
ATCAACGGCGCCCAACAAGAAGAAGTATTCACCGGCACCGTAGAAAAAGCCTTCGAAGAG
TGGGCAGCCGAAAACCCAGTCAGCCCATTTGAGGTCATTGACGGCCAAAGCTGCTCCGTC
GACGGCACCTGCAAC

>RXN00784-downstream
TAACTTTTGGGACCTATGTGCGT

>RXN00792-upstream
CACCTTTGGTGCTGAGCCAGGCCACCCAGGCCTTTGAGGTTGGCGCAGATGCCTTAAACG
GCGGCCACGTGGCTGCCCAATACACGATCGGATCCTTGTC >RXN00792
ATGAGCCAAGAAATTTTGAGCCATTTTGCACCCGCATTAGAGCGCATTCGAAGCGGCGCC
GTCGAGCGCGAACAGCAGCGCGCCTTGCCAGTGGAAGAGATTAAAGAGCTGGTAGAGCTA
GGTTTTACTGGGCTTCGAGTGCCCGAAGAACTAGGCGGTGCGGGCGCTTCCCTGGAAAGC
GTAGTTGAGTTACTGATCGAGATCGCGGGCGCCGATTCCAATATCGCCCAAGCCCTGCGC
GGACATTTTGCCTTCGTGGAACTACTCCTGGAAGCGCCGGAGAGCGAATTCCGCACCCAT
TGGCTGCGCGAAGTCGCCACCGGAAGACTTGTGGGCAACGCCGAAAGTGAGAAACGCGGC
GTTTACGGCGATCCGCAGACCTTCATCGATGAGGTGGAGACTGAAAACGGACCGATTTTC
GTGCTCAACGGCACTAAGTTTTATACCACCGGCACCTATTTTGCGGACTACACCTGGACC
ACCGCGCTGCTGCGCAACCTTAACGGCCAAGAAACTTTGGTCAGTTTGCCGGTCGATCTG
CACGCGCCGGGCGTGGATGTTGCTGATGATTGGAGCGGGTTTGGGCAAAAGCTCACCGCC
TCTGGAACGACCACGTTTAAAGACCTGGAGGTGGATCCGCGGTGGATCATTCCACGCACT
GATGCGCCCACGCTGGTGTGGACGTATCTGCAGCTGAGCCTGCTGACCGTGCTGGTTGGC
AGTGCCGCAGCAGCTGTCGATGAGGTGGTTGCCCGCGCCCAATCCTCCACCAGAAATGCG
TGGAACCCTGGCGTCGAGCGCCGCAGCGATCCGGCCGCAACCATAGCGATCGGCGACGCA
CGCAGCCGAGTCACCGTTATTCGTGGAGCGCTTCTCGACGCCACCCGCCACGTTTCCAAC
GCCGCCACGATCGTAACCCCCGAAGCCTTCAACGAGGCGGACGCTATTGTTGCAGCGCTC
TGGCCCATCGTCTCCGGACAAGCTTTGGTGGTGACATCCAACGTTTTCGATGCGGTGGGT
GCATCTGCAGTGCTTGGTGAGCATTCCATTGATCGCCACTGGCGCAATGTGCGTACCGTG
TCCTCAAACAACCCGGTGTTCCTGGCCAAGAATGCAGTGGGGGAGTATGCCCTCAACGGC
ACTCCTGTGGGTACCAACATTGGTAAAGCACTGAGCCGTCCGGTGAGCCTAAGCAGC >RXN00792-downstream
TAGACGTGTGATTTCGCTGGTTT >RXN00819-upstream
GATGAGGTTCGTCCGGGAATCCTCAAAGACAATGCGGTGAAGGTACTTGGCCTAGCCGCT
AGCACTGAGCGCGGATCTCAAGCAGAAAAGGTCGTGCAAC >RXN00819
ATGCGTGATCCCATTCAAGGTGCTGTTATTCCTTCTGATCTTTTTGGTTTCGCAGAAGTT
CTCACCGAAGCCGAACGCGCAGTTCTTCTGGAAACCCGCAGGGTGCTTGAGGAAGAGGTG
AAGCCTTATATTAATGAGGCCTGGGATAAGGCAGTCTTCCCCGATGAGATCGTGCAGCCC
CTCCAAGATCTGCAATTGCTTGATCCGCCTGCACTTCGGGAAGCAGGGGAGTCGGTTCGA
GACATTTTCACTGGTTTCCGCAATTTTGAACTCGCGCGCTGTGACATCAATGTTGGTACC
TATTACAACGCATCTGCTGGTCTCTTCCGAACGGCCTGCATGGTTGGTGGCTCCCCGGAG
CAGGCGCAGCGATTGGATGCGCAGATCAAATCTGGTGAGGTCAAGGGCGTTTTTGCACTG
ACGGAACCTGATCATGGCTCTGATATCGCAGGTGGTCTGGCAACCACGGCCACTAAGGAC
GCAGACACCGGCGAGTGGATTATCAATGGTGAAAAACGGTGGATCGGTGGTGCTTCCACT
GCTGATTTGATCGCTACCTTCGCCAGGGATACAGCCGATAACCAGGTGAAATGCTTCCTC
GTGGCACCTCAGGCAGAGGGCGTGTCCATGGAGATTATTGATCGCAAAGCCTCACTGCGC
ATCATGCAAAATGCACACATTACCTATAACAATGTCCGGGTGTCTGGGGATGCGCGGCTG
CACAACATCAATTCTTTCAAGGATGTTTCGGAATGCCTGCGCCGTATGCGTTCCGATGTG
GCGTGGATGGCGGTCGGTGCGCAGGCAGGTGCCTATGAAGCAGCCGTGAAGTATGTGCGC
AGCAGGGAACAGTTTGGCCGTCCGATCGCGGGGTTCCAGTTGATTCAGGAAAAGCTCGCG
CTCATGCTGGGCAATCTCACGGCGTCGCTGGGCATGATGGTCAAACTCACCGATCAGCAG
CAGGCGGGAATTTTCAAAGAGGAAAACTCCGCGCTGGCGAAAATGTTTACCTCGCTCAAA
CTTCGGGAGACCGCTAGTTGGGCGCGGGAAATCTGCGGAGGCAACGGCATCATTTTGGAC
AACGATGTTGCCCGGTTCCATGCCGATGCAGAAGCCGTCTATTCATATGAAGGCACCCAC
GAAATCAATGCACTCATCGTTGGNCGNNCCATTCTGGGNCNTCTNTTCTTTTTATATTAT
```

Appendix A, page 91

```
NACNCTTTTGAGGAGGATCTTCATGACTACTTCCACCACCCCAAACCATCGTTTCTTTCG
AAGACGCACCAACCCTCACCGGCCAGGACCTGGGCTTTTCGCAGTGGCGCACTGTCACCC
AGGAGATGG
```

>RXN00819-downstream
```
TGAACACCTTGGCGGACGCAACT
```

>RXN00832-upstream
```
GAGATTGTGCTAGGTTCTGATGAGGCTTCGGGACGACCCGAAGAAATCTATGACAGCCTG
GGAACGGCCCAGAGTTCTTAAGAAAGTTTGACTAGAGAAC
```

>RXN00832
```
ATGCCGTTTTCTTGGCTAAAACCAATTGATTATGCCCGCATCTTTGTCGGCTGGGCATCG
ATTTTTATCATCCCCCTCATCACACTGCCATCAATTATTGAGTTGGCGCTGATCGTGGCA
GTCATCCTATTCTGCGCATTTGGCGTGGTGAAGATGGCGGAGCGTTTGGCTCATATTTTG
GGTGATCCTTTTGGATCGTTGATCCTTACCTTGTCGATCGTGATCATTGAAGTGATTTTG
ATCTGTGCGGTGATGCTGGGGCCTGCTGATTCAACCACTGCTGGTCGGGATTCCGTGATG
GCAGTGTCCATGATCATCATGGGTTTGGTCGTGGGATTGTGCCTACTCATTGGTGGTTTA
AGGCATGGAAGCATGCCACACAATGGGGTGGGAACTCCGACCTACTTGGTGCTGATCGCA
ACTTTTTCCGTAATCGCCTTTGCGGTTCCAGCTTTCAGGGGAGAATACTCCACTGGGCAG
GCACTTGTTATTTCAACACTGACAGCAGTGGTGTACGGGTTCTTCCTGTTTCGCCAAATG
GGTGCCCAAGCTGGTGAATTTCAAGAGGTCGAGGTCGCAGAAAAGGCAGACGACGCAGCA
AAATGGGAGGTCCCATTTAGAGGCTTAATCTTGATTATCACTGTGCTCCCCATCGTGTTG
CTGTCCCATGACATGGCCACGGTGATGGATGAAGTCCTGGCAAGCCTTGGTGCACCCGTA
GCAATGGCTGGATTAATTATTGCCACCATTGTCTTCTTGCCAGAGACCATCACCTCCTTG
AAAGCTGCGTGGACAGGAGAGATTCAGCGAGTAAGCAACCTCGCGCATGGAGCCCAAGTA
TCAACGGTGGGGCTGACAATCCCAGCTGTTCTAGTGATCGGCGTGATCACAGGTCAAGAT
GTAGTTTTGGGGGAGACCCCGATCAACTTGTTGCTGCTGGGAACCACCATTGCGGTGACA
GCCATTGCGTTTAGCTCCAAGAAAGTCAGTGCTGTGCATGGCTCGGTGCTGCTCATGCTT
TTCGGTGTTTACATGATGAGCATGTTCGCC
```

>RXN00832-downstream
```
TGATTTAGGTAGCCTGGTGGGAA
```

>RXN00842-upstream
```
CCTTGTCGCGGAGGTAAGCGAGGGTATTTCTGGATGTGGAACAACGCGGATTATGGAAAA
TCGTGACTTTCATAACGTTGAGCCTACTAAGGTTTGTTCC
```

>RXN00842
```
ATGATTATTCAAATCCTAAGAGTGGCATTTGCCTTCGTCGGCATCATTGTTGGCGCCGGT
TTCGCATCAGGGCAAGAGGTCATGCAATATTTTGTGGCCTTCGGCATAGACGGAATTTGG
GGAGTCATTGTTTCTGCAGTGATCATGTCGGTGATGGCGTTGATCATTTTGCAGCTCGGA
AGCTATTTCAATGCAGGTGAACACGGTGAAGTGTTCCGCCGAGTAAGTCACCCCGTTTTC
TCCAAAATTTTGGACATCGGCGTTGTGGTGACGTTGTTCTCCACCGGTTTCGTCATGTTT
GCAGGCGCGGGATCAAATCTGAATCAGCAGTGGGGGCTTCCGCTCTGGATCGGTTCTGTG
ATCATGGTTCTTCTGGTGCTGGCTGCGGGCATGTTGGACGTGGATAAAGTAACCACAGTC
ATTGGTGCAATTACTCCGTTCATCATCATTTTCATCACTGCCGCCTCGATCTACACGCTG
GTAGGTAATTTCAGCTCAGTGGAGCAGCTTGATTCTGCTGCTTTAGAAGTCGGCACGACG
TTGCCTCACTGGGCTGTTGCAGCGGTGAACTATGTGGGATTCAACCTGATGGTTGCGGTG
TCCATGGCTGTGGTCATTGGTGGATCAATGTTTAACCCGCGGGTCGCAGGTCGGGCGGT
TTGCTGGGCGGATTGATCCTGGGATTCTTGATCATCATCAGTGCGCTAACACTGTTCGCC
ACCGTGGAAGAAGTTGGCCAAGATGATATGCCTATGCTGACGATCATCAACAATTTGAAC
CCGCTGGCTGGCCAAGTAATGGCAGTGGTTATCTACGGAATGATCTTCAACACGGCACTG
GGTATGTTCTACGCATTGGGCCGTCGTCTCACTGCGAAAAACCCACAGCGATTCCGTCCG
GTTTATGTGGTCACAGTGCTGATTGGTTTTGTGTTGAGCTTTGTGGGATTCAAGAACTTG
GTGGGCTATGTGTACCCAGTCTTGGGATACATTGGCCTGCTGCTGATTGCAGTGATGATG
GTGGCGTGGGTGAGGGGACGCGTACGCATCTACAAGGAATCCGAACGCCGCATGCGGATC
GCAGACTTGTTGCAGATCGGCCATGACGGAGCGTTGAGTGGAGCAGAGCTGGCGGTGCTC
AACCAGGAAATCCAAGATTCAAACTTGGATGAGGAACAAATTAAAGCAGCGGTTAGGAAG
```

>RXN00842-downstream

TAGTTACTCTGCAGGGACGAGCT

>RXN00931-upstream
CCGTAACCTAATCGTTGAAACATCACCTTATTGCTGGGCTTTGCACGCTACTCTTTGTGA
GTAACCTCACCGAAGTGCATAAATTAATTGGGAGTGATCA >RXN00931
GTGAAAACTATTGAAGATATTTTGACCTTGGAAGAAATCGACCGCGATATTTACCGTGGT
CCCGTTATCGAATCTTATTTAGCCAGGACTTTCGGTGGCCAGGTCGCTGCCCAAGCTTTA
GTAGCAGCAACGCATACTGTTGATAAAGCCTTTACTGTGCATTCTTTGCATGGCTACTTT
ATAGCTCCTGGTGATCCAACAGCACCCGCAATTTATTTAGTGGATCGAGTTCGCGACGGA
AAAAGCTACGTCACCCGCTCGGTGCGTGGCATCCAAGACGGCGAAGTAATCTTCAGCATG
CAGGCCAGCTTTCATCGTGGGGATGAAGGCATTGAGCACATGGACAAGATGCGTAAAGTT
CCAGCTCCTGATGAGATCAAGGGAACAGTAGAACGTATGCCGATCTCAAGTAGGCGAGTG
CTTGATGAATGGGCGGAATGGGATATCCGCGTTATTCCGCAGGATCAATTAGAACTCAGC
GATTTCACCGCTACTGAGCAAGCTGTGTGGATTCGGTGCACCGCTGATCTTCCGGATAAT
CCCACCTTCCACCAGTGCTCACTGACTTATCTGTCCGATATGACTTTGCTGCATAGTGCC
CTGGTGCCACACCCAGGTGAGAAAATGCAGATGGCCTCACTTGATCACGCTGTGTGGTTC
CTGCGTCCCTTCCGCGTCGATGAATGGTTGCTTTATGATCAGCGCTCTCCATCGGCCTCA
AGTGGGCGAGCCTTGACTCACGGGCGGCTTTTCAACCAGCAGGGAGATTTGGTCGCTATT
GTCAATCAAGAGGGAATGACCCGCACACTCCACGAGGGTGCGCAATCAATTCCGATGCGC
AAAGAC >RXN00931-downstream
TAAAATGCAGCGAACTTGAAGAT >RXN00934-upstream
CCAACCCCTGTGGTTTGGTGATTTGGATCCGGAGCGTCTCAAGCGCTCTAGGGAGCAGAC
AAATGTTCACAAACCGGTGGCATTACAGGAGGACAATTAG >RXN00934
GTGCGAATTGGAATGGTCTGCCCGTACTCCTTCGATGAGCCGGGCGGTGTTCAAGCGCAT
ATCCTTGACTTAGCGCGAACCTTCATTGCCCAAGGCCATGAGGTTCAGGTGCTTGGTCCG
TGTAGTGCGGATACGCAGGTGCCCGATTTCGTGGTGCGCGGTGGTGGCAGCATCCCGATT
CCGTACAATGGCTCGGTTGCCCGCTTGAGCTTTGGGCCGAAAATGTTCAAGGCCGTGCGC
ACGTTCCTCCGCGAAGGCAACTTCGATGTGCTGCATATCCATGAACCGAATTCACCAAGT
TTTTTCCATGGCGGCGCTACGCTTTGCGGAAGGCCCCATCGTTGCTACTTACCACGCCTCC
AGTAGCGGATCGAAGCTGCTCAAGGCTTTCTTACCAGTGCTTTCGCCCATGCTGGAGAAA
GTGCGCGCAGGCATCGCCGTGTCTGAAATGGCTCGGCGCTGGCAGGTGGAGCAAGTCGGC
GGCGATCCCGTGCTGATCCCCAACGGGGTAGAGACCTCCATGTTCAAAGCCGCGCGCCAA
ATCGAACCGAATGATCCTGTAGAGATCGTCTTTTTGGGTCGCCTCGATGAGTCCCGCAAA
GGCCTCGACATCCTCCTGCGCGCTCTGACCAGGCTGGATCGCCCGTTTACCTGCACCGTC
ATTGGCGGCGGCACCCCGCGAGAAGTCGCCGGCATCAACTTTGTGGGCCGCGTCAGCGAT
GAGGAAAAGGCAGCAATCTTAGGTCGCGCAGACATCTATGTCGCACCCAACACCGGCGGC
GAAAGCTTCGGCATCGTGCTAGTTGAAGCGATGGCCGCGGGATGCGCTGTCGTCGCCAGC
GACCTAGAAGCGTTCTCCCTGGTCACCGATTCTGAAGCCGCACAGCCAGCGGGCGTGCTA
TTTAAAACCGGCTCAGACGCCGACCTAGCCAAAAAACTTCAAGCGCTTATCGACGACCCC
TCCTCCCGTTCCACGCTTATCGCCGCGGGGCTAAAGCGCGCAAACGCCTACGACTGGTCG
ACAGTATCCACCCAGGTCATGGCAGTCTATGAAACCATTGCGATCGACAAAGTGAGGCTT
GGA >RXN00934-downstream
TGACCCTTGTTTACCTCCTCATC >RXN00960
ATGGCTCGGCATTGTTGCAGCAATCGCTACGCGTCCACCGTCTTCTCCGGTCTGATCGCC
TACGGAGCATCCCAAGCGCTCTACCCATGGCTGCTGAAAGACCACCAAAGCGTCACCGAA
ATCGACCTTGATGCAGGTGCCCTCCAGCCCTACTTCAACATCGAGATGCCACCACCATTT
GAAGTGATGACCGCACTGCTGCTGGCATTCTGCCTCGGCCTGGGCATGGCTGTAATTAAA
TCAGACACCCTGTTCAAGGTAACCCGCGAACTCGAGCGCGTAGTCATGAAGACCATCACC Appendix A, page 93

Att  Docket No.: BGI-125CP

```
GCCTTTGTCATCCCACTGCTGCCACTCTTCATCTTCGGCATCTTCCTCGGCATGGGCATG
AACGGTGGCCTCCTGGAGATCATGTCCGCCTTTGGCAAGGTACTGATTCTCGCCGTCGTG
GGAACCCTGCTCTTCCTAGCCATCCAGTTCATTATCGCTGGTGCAGTATCCAAGAAGAAC
CCATGGAAACTGTTCAAAAACATGCTCCCTGCATACTTCACTGCACTGGGCACTTCCTCT
TCAGCGGCAACCATCCCAGTGACCTACCAGCAGACCCTGAAAAACGATGTTGATGTCAAC
GTCGCAGGCTTTGTTGTCCCACTGTGCGCCACCATCCACCTAGCTGGATCGATGATGAAG
ATCGGCCTCTTCACCTTCGCTGTTGTCTTCATGTACGACATGGAAGTAGGCGTCGGCCTC
TCCATCGGATTCCTCCTCATGCTGGGCATCACCATGATCGCCGCACCAGGCGTTCCCGGC
GGAGCCATCATGGCAGCAACCGGCATGCTGGCCTCCATGCTCGGATTCAACACCGAACAA
GTCGCCCTCATGATCGCCGCTTACATCGCGATTGACTCCTTCGGCACCGCAGCAAACGTC
ACCGGCGACGGCGCAATCGCAGTCATCGTGAACAAATTCGCCAAGGGCCAGCTGCACACC
ACTTCCCCAGATGAAATCGAAGAAGACGACCGCGTTGCCTTCGACATCACTCCATCGGAT
GTGGAACATCACAAG

>RXN00960-downstream
TAGAAACCCGCATTTTCTGTAGT

>RXN00980-upstream
AGAGAGAAAGGGAGAAATCATGAAAACGTGGAAGACCTGGGGGGTCGTCGGAGCTTCAGG
CCTCTTGATTATTTTGTCGTGGTTGAGTTCATCGAGCCCG >RXN00980
ATGCTGGCAGATGCATTCATGATCGCGGCTGCAATTGTTGCAGGTTGGCCGATCGCGCAG
TCTGCATATCAAGCACTTCGCATTCGAATGGTGTCGATTGACTTACTGGTCGTTGTGGCT
GCCGTTGGTGCCATGTTCATCAACAACTATTGGGAGTCTGCGGCGGTGACGTTCCTCTTT
GCCCTTGGCAAGGCACTGGAACGCGCGGACAATGAACCGCACACGAAAAGCACTATCGGAT
CTGGTGGATGCAGCTCCAGAAACTGCAACAAGGCTCAACGCGGATGACTCAACAGAGGTA
GTTGAGCTGTGGGAGCTTGAGCCCGGTGACATCGTCTTGGTACGCAATGGCGAACAAATT
CCCGTCGATGGAAACGTGATTGCGGGTGTCGGTGGAATTGATGAATCCAACATCACGGGT
GAATCAATGCCGGCTGAAAAGGGTCAAGGCTCTGATGTGTATGCAGGAACCTGGCTGCGA
TCTGGTGTTTTGAGAGTCGAGGCAACAGGAATTGGTTCAGACTCAACTTTGGCAAAAATC
ATTCACCGCGTTGAAGACGCCCAGGATGACAAAGCCCGCACACAAACATTCTTAGAGAAA
TTCTCTAAGTGGTACACCCCGGGCGTCATGATCGCCGCCGCAGTGGTGGGACTTATCACC
TGGGACGTAGAACTAGCACTGACGCTCTTAGTGATCGGCTGCCCCGGCGCGTTGGTTATC
TCCATCCCGGTGTCCATCGTCGCAGGCATCGGCCGTGCTGCACGCGATGGCGTGCTGATC
AAGGGTGGAGAATACCTAGAAACCGCCGCGAAAGTCGACGTCGTTGTCGTGGACAAAACT
GGAACGCTGACCACCGGCCGCCCAGAACTCACAGACGTAGAAGTCATCGAGCCCGCCTAC
AGCCAGGGCGAGGTGCTGGAGCTCGCCGCGCGCGCCGAGACGGCTTCAGAACATCCGCTT
GCCGACGCCATCATCCGTGGTGCCCAGGATCGGGGCTGTCCACAACATTGGTGGAAGCA
GCTGAAAACATCACCGGCCGAGGCATTATCGCAAATGTTGATGGACAGGCAGTTGCTGTT
GGATCTGCTGAGTTACTTGATCATGAACCAGACTCGACCAGGATCCTGGAGCTAAATGCC
GAAGGAAAGACCGGCGATGTTTGTCGGAGTGAACGGACACGCCATTGGAATCGTGGCCGTC
GCCGACGCCGTTCGTTCAGATTCTGCCTCAGCAATCGAATCGCTGCATAAGGCGGGCATT
CAAGTTGTCATGGCGACTGGCGACGCTCACCGCGTTGCACAAAACGTGGCCTCCAAGCTG
GGAGTGGATGAAGTCTACTCAGAGCTACTCCCTGAACAGAAATTAGAACTGGTGCGTGAT
CTGCAAGCTGCCGGCAAAACGGTCGCGATGGTGGGTGACGGAGTCAACGACACCCCAGCA
TTGGCAGCTGCTGATATCGGAGTAGCGATGGGCGTGGCAGGTTCCCCTGCAGCCATTGAA
ACCGCTGATATCGCACTCATGGCGGATCGTCTCCCACGGCTGGCACATGCAGTGACCTTG
GCAAAACGCACCGTAAGAACCATGCGCATCAATATTCTGATTGCGTTGGCTACCGTGATG
GTGTTACTAGCTGGCGTCCTATTTGGCGGAGTTACCATGTCGGTTGGCATGCTCGTTCAC
GAAGCAAGCGTGCTGCTTGTTATCAGCATCGCCATGCTGTTGCTGCGTCCAACACTTAAA
GAAGATGCTGCGCAAGCAAGTGATATTAAACGCTCGGAAATACAACAGATCGCA >RXN00980-downstream
TAACCAATGGCTGGGTACTGATG >RXN01000-upstream
CTTTCTATGCCTACGCGGATGTTTCCGTGATCATTCTGGAAATCCTCATCGTGGTGATTG
TCATTGAAGTAATCTCCAACGCACTTCGAAAGAGGCTGGT

>RXN01000
```

Appendix A, page 94

Att    Docket No.: BGI-125CP

```
ATGAGCACCTTAACCTCTCACCGCACAGTACCGGCCCCCAGCTCTCCCCCGGCGCGCCCC
AACAAACTGGCGCGCAATATCGTTGCAATTGTCGCTGCGCTGATTGTCCTTATAGCTACC
GGCACGCTCAAGATCGAGTGGAATGAGCTTCCGCAGATGCCCGCGCAGGTGTGGCATTAC
TTAGAGCTGATGTTTAGCGATCCCGATTGGTCGAAGTTTGGCCGCGCCGTCCAGGAAATG
TGGCGTTCCATCGCCATGGCGTGGTTGGGTGCCATTTTATGCGTGGTGGTCTCTGTCCCT
CTGGGAATGTTGGCTGCCCGCGGGGTGGGACCTTATTGGCTGCGTACCGTTTTACGGTTC
GTGTTCGCGGTGATTCGTGCGTTCCCCGAAGTGGTTATCGCAATTATTTTGCTAACTGTC
ACCGGCCTAACTCCTTTTACTGGTGCGCTCGCATTGGGTATCTCCGGTATTGGACAACAG
GCAAAGTGGACCTATGAAGCCATTGAGTCCACTCCCACCGGCCCGTCAGAGGCAGTGCGT
GCAGCGGGTGGAACTACGCCGGAGGTTCTGCGGTGGGCGTTGTGGCCACAGGTTGCGCCA
TCCATTGCATCTTTTGCCCTGTACCGCTTTGAGATCAACATCCGTACCTCTGCGGTATTG
GGCATCGTTGGTGCAGGTGGTATCGGTAGTATGCTTGCCAATTACACCAACTACAGGCAG
TGGGACACCGTGGGCATGCTGCTCATCGTCGTGGTTGTCGCAACGATGATCGTCGATCTC
ATCTCCGGCACCATCCGCCGCCGCATCATGAAGGGGGCTAGTGACCGTGTCGTGGCACCA
AGCAAC

>RXN01000-downstream
TGACGCTCCACCAAGCATCCGCA

>RXN01002-upstream
GACTGCTGATACCGCACAGGATGAAATCACTCGTTACGGCGAGATCCTGAAGAAGTTCTC
CAACTAATTTCCCTGTTTCCAATACTCAAGGTGTGCGCAT >RXN01002
ATGAATTCTGATGCTTCGGCTACCACCAACTCCTGGGCTATCAACTTCGACCATGTGTCG
GTGACGTATCCCAATGGGACGAAAGCCCTCGATGATGTTTCCCTCACCATCAATCCCGGT
GAGATGGTTGCCATCGTGGGTCTGTCAGGATCGGGTAAATCCACGCTGATTCGCACGATC
AACGGTCTTGTCCGCGCTACGGAAGGCACCGTGACGGTGGGGCCGCATCAGATCAACACC
TTGAAGGGGAAAGCACTGCGTGATGCCCGTGGGCAGATCGGCATGATTTTCCAGGGGTTC
AACCTGTCGGAACGCAGCAGTGTGTTCCAGAATGTTTTGGTGGGCCGCTTCGCGCACACA
GCGTTGGAGTCCGTGGGCATTTTGCACAAAGTGTGGACCCGAGCTGGTGCTTTGTCGGGT
GGACAGAAACAGCGCGTTGCTATTGCGCGCGCCTTATCGCAAGATCCGTCTGTCATGCTG
GCAGATGAGCCTGTGGCAAGCCTTGATCCGCCAACCGCGCATTCCGTGATGCGCGATCTA
GAAAACATCAACAACGTGGAAGGCCTCACCGTGTTGGTGAACTTGCACTTGATTGATTTG
GCTCGTCAATACACCACAAGGCTTGTGGGTTTGCGTGCCGGCAAGCTGGTCTATGACGGT
CCTATCTCTGAGGCCACCGATAAAGACTTTGAAGCTATCTATGGTCGCCCCATCCAGGCT
AAAGACCTGCTAGGTGATCGCGCA >RXN01002-downstream
TGACCACGCCTTCTTCTACACTT >RXN01007-upstream
TCTGAACCAATATACCGATCAGTCTAAAAGTGTGTTAAGTTCTGGAACATAAATTAGCTG
ACACGTAAAGTAACTTAAAGATTCACTGGAGGTAAGCCTA >RXN01007
GTGTTTAAAAAGCACAGACACGGTCTCGGCTCCCCCGAAACCAAACCACGCTCAATAACC
CGCCGGTTTTTCACCGCGGCCGCCGCTACGCTGGCAGGATTGGCAGTCCTGTCCGGCTGC
ACAGCACAACCCTCACAAGCAGAAGACAACACGCTCACTTACTTAGAGCCACAGTTCTTC
CGCACCCTGTACCCACCATCAGCGGGCTTTTACCCCAACGGCAGTGTGGTGAACAACATT
GCAGACCGCTTGCTCTACCAGGATCCTGAAACCTTGGAACTCAAGCCGTGGATCGCCACC
GAACTCCCAGAAGTAAACGAAGACGCCACGGAATTTACCTTCAACATCCGCACCGATGTC
ACCTACTCCGATGGCACCCGCTTGACGGCTGAAAACGTGGTGAAAAACTTCGATCTCTAT
GGCCTCGGCGATCAAGATCGACGCCTCACCATCTCTGAGCAGATCACCAACTACGACCAC
GGCGAAGTAGTAGATGAGGACACCGTCCGATTCCACTTCTCTGAGCCTGCACCTGGTTTT
GCTCAGGCCACCAGCTCCTTCAACGCTGGCCTTTATGCCGATTCCACCTTGGAGTTCGCC
AATGAGGATTTCGCGCCAGGCAACGCCCAAAACGTCATCGGCTCCGGTCCTTTCGTGATC
ACCGATGAAACCCTAGGCACCAACCTCACCTTGACTGCGCGTGAGGATTACGATTGGGCA
CCACCATCACGCGAACATCAAGGTCGCGCGAAGCTTGACGCCGTCAATTATGTCCTCGCG
GGTGAAGAATCCGTCCGCATCGGAGCCATCGTTGCTGGCCAAGGTGATATCGCCCGCCAG
```

Appendix A, page 95

```
ATCGAAGCGCCAGTGGAGGCACACCTGAAGGATGCAGGCATCCCGATCATCTCCGCAGCC
ACCAACGGTGTGAACAACAGCTTCAACTTCCGCTTCAAAAACGAGCTGCTCTCAGACATC
CGTGTTCGCCAAGCTCTGATCCACGCGATCGACCGCGAAAAGATCATGCGTGTGCTGTTT
AGTGATTCCTATCCGCTGGCAACTTCTGTGCTTGCGCAAAATGCACTGGGCTACAAAGAA
CAAGTAGATGCCTATGTCTACGACCTAGACAAAGCAACAGCTCTGCTTGACGAAGCCGGC
TGGACCCTTGATAGCGACGGCATGCGTCGCAAGGACGGTGAACTTCTAGAGCTCACCTTC
AACGAAGCCCTCCCACAGCCTCGTTCACGCGAAGTTGTCACCATGGTCCAAGAACAGCTC
GGTGATCTGGGCATCAAGGTCAACCTCAACCCAGGTGACCAAGCAGCCCAGGACGCTGAC
TCCAAGGATCTCAACAAGATCCAGGTTCGCCACACCATGGTGGGTCGCGCAGACTATGAC
GTGCTGAAATCCCAGCTGTACTCCACCAACCGCAACGAGCTGTTGAACATGACCGTGGAA
GGGGAGACCGCCGATATTGGCGATCCTCATTTGGAGGAACTCCTCATGGCTATTGCATCC
AGCCCACGCGAAGAGGACCGTGCAGCAGCATCTGCCGCAGCACAGGATTACATCACCGAG
CAGGCATATGTTCTTCCACTGTTTGAAGAGCCAGTTGTCTACGGCGTGCAGCCTTACGTG
AAGGGCTTTAGCCCCGAAGTGATCGGCCGCCCCAGCTTCTATGAGACCTACATTGACCAT
TCCAGCGACCATTCCAGTGAGGAGGAC

>RXN01007-downstream
TAAATGACTACCTCGCAGATTCT

>RXN01090-upstream
GCCGGTTTGGGCTGGTTGGAGCTCTAGATCGTAAGTGGTGTCGTACCCATGACGTACCAT
TAACCACGAACGTTTTAAAGAAGCCACGAAGGAGCCTGAC >RXN01090
ATGGCGTTACCACTACCCAGCAAGAGCGCTCGAGCACTTGTTACTGGGGCAAGCCAAGGC
ATTGGCCTCGCCATCGCCAAAGATTTGGCGCGGTATGGGCACAACCTCATTTTGGTTGCT
CGCCGCGAGGATGTCCTCAAAGAGATCGCCGCAGATCTAGAGAAGAAGCACGGCGTGATC
GTTGAGGTCCGCCCGGTGGATTTGAGTGATGAGCCAGCCCGCAAGGTGTTGATCGATGAG
ATCAAGACAAGGGAAATCAACATCATCATTAACTCTGCTGGCATCGCAAGCTTTGGGCCG
TTCAAGGACCAGGATTGGTCTTATGAGACTGCCCAGTTCTCACTTAATGCCACAGCCGTT
TTTGAGCTCACCCACGCGGTGTTGGGTGGCATGATTGACCGTGGCACGGGCGCTATTTGC
AATGTGGGATCTGCGGCTGGCAATGTGCCAATCCCCAACAACGCCACGTATGTGCTCACC
AAGGCTGGCGTGAACGCGTTCACCGAGGCAATGCATTATGAGCTGCGCGGAACTGGTGTG
GCGTGTACTTTGCTCGCACCGGGACCTGTCCGTGAGGCGGAGATCCCTGAGTCTGAGAAG
TCGATCGTGGACAAGGTTGTCCCTGATTTCTTGTGGACCACCTATGAGTCCTGCTCCGCA
GAGACCTTGCGTGCGCTGTCTAAGAATCAGCGTCGCGTTGTTCCAGGTCCGCTGTCCAAG
GCCATGAATTTTGTGTCCTCTGTTGCTCCAACCGCTGTGCTCTCCCCTGTTATGGGCTGG
GTTTATAAGAAGATGGGT >RXN01090-downstream
TAGTTTTTAAAAGTGTCTGAATC >RXN01114-upstream
TTCGGTGGAAGATATCCGCAAGCTGGTGCTGCCGCAGCTTTTAGAAACGGCTCAAGCAAT
TTCGACAGATCTCTCTGCACTCTAAATTAAGGATCAAAAA >RXN01114
ATGAACCCTCAAGATATTGTCATCTGTTCCCCATTGCGCACCCCAGTTGGTGCTTACGGC
GGATCCTTCACCGGCGTCCCTGTTGAAGAATTGGCCACCACCGTGATCAACGCGATCGTT
GAGGCAACCGGCATCACCGGCGACGATGTGGACGATCTGATCCTCGGCCAGGCATCCCCC
AACGGTGCGGCTCCAGCACTGGGCCGTGTTGTTGCTCTAGATTCCAAGCTTGGCCAAAAC
GTTCCAGGCATGCAGCTTGATCGCCGCTGTGGTTCCGGCCTGCAGGCAATCGTCACCGCT
GCTGCACACGTTGCATCCGGCGCTGCTGATCTGATCATCGCAGGTGGCGCAGAATCCATG
AGCCGCGTTGAGTACACCGTGTCCGGCGATATCCGTTGGGGTGTCAAGGGCGGCGACATG
CAGCTTCGTGACCGCCTTGCAGAAGCACGCGAAACCGTGGCGGACGCAACCACCCGATC
CCTGGTGGCATGATCGAGACCGCTGAGAACCTGCGTCGCGAATACGGCATCTCCCGCGAG
GAGCAGGACAAGATCTCCGCAGCGTCCCAGCAGCGTTGGGCAAGGCTGCTGATGCGGGG
CTTTTCGACGACGAGATCGTGCCAGTCACCGTCCCTGCCAAGAAGCGCGGCCAGGAGCCA
ACCATCGTTTCTCGAGACGAGCATGGTCGACCAGGAACAACCGTCGAAAAGCTTGCTGCT
TTGCGCCCCATCATGGGCCGCCAGGATGCGGAAGCAACCGTCACCGCTGGCAACGCGTCC
GGCCAAAATGATGGCGCTGCTGCCGTCATCGTGACCACTCGCGCCAAGGCCGAGGAGAAG
```

```
GGCCTGCGCCCAGTCATGCGTTTGGCTGGCTGGTCTGTGGCTGCTGTTCCCCCAGAGACC
ATGGGTATTGGACCTGTTCCTGCCACCAAGAAGGTCCTGGATCGTTTGGGCCTTACCCTG
GAGGACATCGGCGCGATCGAACTCAACGAAGCTTTCGCAGCTCAGGCACTGTCTGTGCTG
AAGGAATGGAACATTTCTTGGGAAGATGAGCGCGTCAACCCACTGGGTTCCGGTATTTCC
ATGGGACACCCAGTCGGTGCCACCGGTGCTCGCATGGCAGTAACCTTGGCTCACCGCATG
CAGCGTGAAAACACTCAGTACGGACTGGCCACCATGTGCATCGGTGGCGGCCAGGGTCTT
GCAGCTGTCTTTGAAAAGGAGAAC
```

>RXN01114-downstream
```
TAAAAATGGCTATTTTGCACAGC
```

>RXN01139-upstream
```
ACCACCGTGGCAGGCTTTTTCAGTGGCAAGAAGATTAATTCTCCACCCCTTCATTTTCAA
TAAGCTTTCAATAAGGGGAGAAGTGTGCTTAGCTGGGTC
```

>RXN01139
```
ATGGAAAGCCACGATCTTCAGCAGCGCAGTTATGCGCACAATCCCGATGGCCACGACCAC
AGCCATGACGGACTCGGACACTCACATGCTCCCAGCTCCCTCAAGGCTCTTTTTGCGGTC
ATCATTTTCACCTCGATCATCTTCCTAGCGGAACTAATCGCCGGCCTTATTTCCGGATCT
TTGGCACTGCTGGCTGACGCCATGCACATGCTGTCCGACTCCACTGGCTTGATCATTGCG
GCTGTCGCCATGCTCATTGGCCGTCGGGCACGCACTTCTCGTGCGACCTACGGATACAAG
CGTGCGGAAGTCTTGGCAGCGATGGTTAACGCCACCGTTGTTACAGCACTGTCTGTGTGG
ATCGTCGTTGAGGCCATCATGCGTCTGGGCAAGGACCTGGAAATCCAGACCAACCTGATG
CTCATCGTCGCGGTCATTGGTTTTGTCACCAACGGAATTTCCGCCCTGGTGTTGATGCGC
CACCAAGATGGCAATATCAATATGCGTGGAGCATTCCTTCACGTTCTCAGTGACATGCTG
GGTTCCGTTGCCGTCATTATTGCGGGCCTGGTGATTCGCTACACGGGATGGATGCCGGCC
GATACCATTGCTTCGATTGCGATTGCTGCGATTATTATTCCTCGCGCATTCAGCCTCCTG
AAGGAAGCTCTCAATATCTTGTTGGAGCGTGTTCCTACAGGTGCGGAGCCTGCAGAGGTC
GACGCAGCCCTTCGTAAAGTCCCAGGTGTCAGCGATGTGCATGATCTTCACATTTGGAGC
ATTGACGGCAAGGAAATCCTGGCCACGGTGCATTTGGTGGTGGATTCGTCTACAAATCAG
CTGCATAGTTGTGGCGTGTTGGATCGGGCAGAAGCGGAACTATCCAAACTTGGGATCTTG
CACTCAACAATTCAGCTGGAAAGCGCAGATCACAGTGATCATGAAAGTGTGTGC
```

>RXN01139-downstream
```
TGATATAGAGTATGTCCCATGGG
```

>RXN01141-upstream
```
AAAGAACACTCGGTATGGCACCTGATTTAAGGATGCTGCAATCGTGACACATATCCTCTT
CGACAGCAGGCGTTTTCTGCAACTGGGCGCTTTTGCGTCC
```

>RXN01141
```
TTGAGCACCGCATTGGCCGGAGCGGCCCGCTACGTGACGTCGACAAGCAATAATGAACCT
GCGGATAACACTCCCCTGACCATTGGCTACGTGCCTATTGCGGGCTCGGCGCCGATTGCT
ATCGCAGATGCGCTAGGGCTGTTTAAGAAACACGGCGTGAATGTCACGTTGAAGAAGTAC
TCAGGCTGGTCCGACCTGTGGACCGCCTATGCAACAGAGCAGCTTGATGTTGCGCACATG
CTGTCGCCGATGACTGTGGCGATTAATGCTGGAGTGACCAACGCGTCGCGCCCGACGGAG
CTGTCGTTTACCCAGAACACCAATGGGCAAGCAATTACCTTGGCGTCAAAGCACTATGGT
TCCGTCAATTCAGCGGCGGATCTTAAAGGCATGGTGCTGGGAATTCCTTTTGAATATTCA
GTCCATGCGCTGCTCCTGCGCGATTATCTCGTCTCAAACGCAGTTGATCCCATCGCCGAT
CTTGAGCTTCGCCTGCTCCGACCTGCCGATATGGTCGCACAATTGACAGTTGAGGGCATC
GATGGATTCATTGGGCCTGGGCCGTTTAATGAACGCGCCATCAGCAATGGCTCCGGCCGG
ATTTGGCTGCTGACCAAACAACTGTGGGACAAACATCCATGCTGCGCCGTGGCGATGCC
AAAGAGTGGAAAGCTGAACACCCCACGGCGGCTCAGGGTGTGCTTAATGCGCTGGAGGAA
GCCTCCGCAATTTTGAGCAATCCGGCACAATTTGATTCCTCGGCACGCACGCTGTCGCAG
GAAAAATACCTCAACCAGCCTGCCACGTTGCTGGATGGACCGTCG
```

>RXN01141-downstream
```
TAATCATCGGCATCACCGGCTTA
```

>RXN01142-upstream
```
CTCCCCATCCACCGGCACAGTCAGCGCAGGCAACGAAGAAATTAAAGGACCAGGACCTGA
```

Appendix A, page 97

CCGAGGCATGGTTTTCCAAGACCACGCCCTCCTGCCCTGA

>RXN01142
TTGACCGCACGCGGCAACATCGACTTCGGGCTCCGCTCCGCGCGCCCCTCCTTGAGCAAA
ACCGAACGCGCCGACATCACCCGCACCCACCTCGAACAAGTAGGCCTCACCGACGCCGCC
GAACGGCGCCCCGCCCGCCTCTCCGGCGGCATGCAACAGCGAGTCGGCATCGCACGCGCC
TTCGCCATCGACCCACCAATCATGCTTCTCGACGAACCCTTCGGCGCCCTCGACGCCCTC
ACCCGCCGCGAACTCCAGCTCCAACTACTCAACATTTGGGAAGCCTCCCGCCGCACCGTC
GTCATGGTCACCCACGACGTCGACGAGGCCATCCTGCTCTCCGACCGAGTTCTCGTGATG
TCCAAGAGCCCCGAAGCCACCATCATCACCGATATTCCAGTGAATCTTCCCCGCCCCAGA
CACGAGCTGAGTGAAGACGCTTCTGTTGAAGCCGAGACCACAGCCCTGCGTAAGCGGATG
CTGCATCTGCTGGAGCAC

>RXN01142-downstream
TAGTTTCTAACACGTCTTTTAAA

>RXN01164-upstream
GCCGATCGTGATTGATGAAGACGAGATCCAAGCCTGGACTTCTGATCTCAAACCTGAAGA
TTTCACCAAAGGTAAAGATGAATCCGACGGTGAGAAATAA >RXN01164
GTGACACTGTTTGTTCGGCTCGCCCTTGCTGCTGTGGGCGGGCTTTTTGTCTTTGCTTCC
AATGAACCGATCGGCTGGTTTGTCGCGGGAATTGTTGGCACTGCATTATTTTTTATCTCC
CTTGCGCCGTGGGATCTGGGAGTTCCCCAAAAGCGGCGGAAGAAGAATGAGCCAGTCCCA
TTTTTGCAACAGATGTCCACGGGCCCAACTGTTGTACAGGGCATGCTTTTAGGTTTTGTC
CATGGCCTGGTGACATATTTGCAGCTGTTGCCGTGGATCGGTGAGTTTGTTGGCTCACTG
CCTTATGTCGCGTTGTCAGTTGTCGAGGCGCTTTATTCCATTGCTCTTGGTGCTTTCGGC
GTGCTCATTGCGCGTTGGAGGGACTGGAAGGTTCTCCTGTTTCCGGCGATGTATGTGGCT
GTGGAGTATCTAAGAAGCTCGTGGCCATTTGATGGATTCGCGTGGGTTCGCCTGGCATGG
GGTCAAATTAACGGTCCGTTGGCTAATCTCGCAGCGTTGGTGGGGTAGCGTTTGTCACT
TTTTCCACGGTGCTGGCTGCCGTGGGTGTGGCCATGGTGATTATTTCCAAGAAGCGACTG
GCCGGCGCAATCATCACCGCGAGTGTGATTGCTATCGGCGCGGTGTCATCCCTGTACGTT
GACCGCAATGGCACGAGCGATGAAAGCATCGAAGTAGCCGCAATTCAGGGCAATGTGCCT
CGGATGGGATTGGACTTCAATGCACAGCGCCGCGCGGTGCTGGCGAATCACGCACGGGAA
ACCCTCAAGCTGGATGAACAAGTGGATTTGGTGATCTGGCCGGAGAATTCCTCAGACGTC
AACCCATTTTCCGATGCACAAGCAAGAGCCATTATCGATGGAGCAGTGGAACATGTTCAG
GCACCTATTTTGGTGGGCACGATCACCGTCGATGAGGTTGGTCCACGCAACACCATGCAG
GTATTTGATCCTGTTGAAGGTGCCGGGAGTACCACAATAAGAAGTTCTTGCAGCCGTTT
GGTGAATACATGCCGTTTCGCGAATTCCTGAGAATTTTCTCGCCCTACGTTGATTCCGCT
GGAAACTTCCAGCCCGGTGATGGCACCGGCGTAGTGGAGATGAATGCTGCGAACTTAGGC
CGCGCTGTGACAGTGGGCGTGATGACCGTGTTACGAGGTCATCTTCGACCGTGCTGGCCGC
GACGCCATCGCCAATGGGGCTGAATTTTTGACCACGCCCACCAACAACGCCACCTTCGGA
TTCACGGACATGACGTATCAGCAATTAGCAATGAGCAGGATGCGTGCCATCGAATTTGAT
AGGGCGGTGGTTGTTGCAGCTACATCGGGTGTTTCGGCTATCGTCAACCCTGATGGAAGC
ATTTCCCAAAACACCCGAATTTTTGAGGCCGCCACCTTGACGGAATCCATTCCACTCAAG
GACACTGTCACCATCGCAGCGCGGGTTGGTTTCTATGTTGAATTACTGTTGGTTATCATT
GGTGTATTAGCTGGACTATTCGCCATTCGAATGAATAGCCGTTCAAAGTCTGCGAAAGGT
TCCGCTCGGCCCGCACAAGTTCGGGTTAAGAAGGTGCCTGCGAAAAAGGCAGCAACTAAT
CGTCGAAAAGTAAAA >RXN01164-downstream
TAAAAACGTCCCGAAGGGACGAG >RXN01168-upstream
CCGCACAAGTTCGGGTTAAGAAGGTGCCTGCGAAAAAGGCAGCAACTAATCGTCGAAAAG
TAAAATAAAAACGTCCCGAAGGGACGAGGAGGACAACACC >RXN01168
ATGAGCAGTGAGGCAGTAGATGCTACGACGCTGGTGATTATTCCAACGTACAACGAGCTG
GAAAACCTTCCACTCATCGTGGATCGCGTGCGCACCGCAACCCCTGACGTTCACGTACTC
ATCGTGGACGACAACAGCCCAGACGGCACCGGCGAGCGCGCAGACAAGCTTGCTGCTGAC Appendix A, page 98

Atty Docket No.: BGI-125CP

```
GACGACCACATTTTTGTCCTCCACCGCGAAGGCAAAGGCGGCCTGTGCGCAGAGTACATG
GCTGGCTTCCAGTGGGGCCTGGAGCGCGACTACCAGGTCCTGTGCGAAATGGACGCCGAC
GGCTCCCACGCACCAGAACAGCTGCACCTGCTGCTCGCTGAGATCACCAATGGCGCTGAC
CTGGTCATCGGCTCGCGCTACGTGCCAGGCGGCCGCGTAGTCAACTGGCCCAAGAACCGT
TGGCTCTTGTCCAAGGGCGGCAACGTCTACATCAGCGTCGCGCTCGGCGCCGGCTTGACC
GATATGACCGCAGGGTACCGCGCTTTTCGACGTGAAGTGCTAGAAGCACTGCCGCTTGAT
GAGCTCTCCAACGCTGGGTACATTTTCCAAGTTGAGATTGCCTACCGTGCAGTTGAAGCC
GGATTCGATGTTCGTGAAGTTCCCATCACTTTCACCGAGCGTGAGATCGGCGAATCCAAG
CTGGACGGCAGCTTTGTCAAGGATTCCCTGCTCGAGGTAACCAAGTGGGGCCTCAAGCAC
CGCGGTGGCCAGGCCAAGGAACTGTCCAAGGAAATGGTCGGCCTGCTGAACTATGAGTGG
AAGCACTTCAAAAAGCGCAACACCTGGCTC

>RXN01168-downstream
TAAACTGCTTGCCGGTTAGTGAA

>RXN01191-upstream
CGCTGCTTTCACGCAACTGAAACCGCACCGGATCAAGTTATTTGGGGTTGTTCTTTGTGG
CGTGTTGGTGGCCGTCGCGGGGTTGGTAGGGCCCTGGGCG >RXN01191
GTGGGTGGACTCGTCGATAAGCTCCTTGCAACCCCGAGCATGCGCGACGTTGTAGTGTTC
GCGCTGCTTATCGTGGCTGGCGGCGTTGTTTCGAGCCTGGGCACGTGGTGGGGCAGCGCG
CTGATGGCGCGCGCGTTGGAGCCGGCGATCGCGGGGCTGCGCGAGGATGTGTTGCGCGCG
GCGGTGAGTTTGGATGCGAACACGATTGAAACGGCGGGGCGCGGCGACGTGATTTCGCGT
ATCGCGGATGATTCGCGGGAGGTGTCCACTGCGGCGAGCACCGTGGTGCCGCTGATGGTG
CAGGCGGGCTTTACCGTGGTGATTTCCGCGTTTGGCATGGCGGCGGTTGATTGGCGCCTC
GGCCTTGTCGGTTTGGTCGCGATCCCGCTGTATTGGACCACGTTGCGCGTCTATTTACCC
CGCTCAGGTCCGCTTTATACGCGTGAGCGCGAGGCCTTTGGGGTGCGCACGCAGCGGCTT
GTCGGCGCAGTCGAAGGCGCGGAAACCTTGCGCGCTTTCCGCGCAGAAGATACAGAATTA
AAGCGTATCGACGCAGCCTCCGGCGAAGCCCGCGACATTTCCATTTCTGTTTTCAGGTTC
CTCACATGGGCATTTTCCCGCAACAACCGCGCGGAATGCATCACCCTCGTGCTCATCTTG
GGCACCGGCTTTTACCTGGTCAACATCGATCTGGTCACCGTCGGCGCAGTCTCAACCGCC
GCACTGATCTTCCACCGACTCTTCGGTCCAATCGGCACGCTCGTGGGCATGTTCTCCGAC
ATCCAATCCGCCAGCGCATCGCTGATCCGCATGGTGGGCGTTATTAACGCGGCATCGAAC
CAGGTCAGCGGCACCTCGCCGGCGTCTGCCAGCACCGCTTTAACGCTTTTCGACGTCTCC
CACCACTATCACACTGCACCCGTCATCAAGAATGCATCCGTGCAGCTGGAACCAGGGGAA
CACATCGCCATTGTGGGTGCGACCGGCGCTGGTAAAAGCACGCTCGCCCTCATTGCGGCA
GGCCTGCTCAGCCCAACTTCCGGGCAGGTGGCTCTCGGCGGATCGAGTTTTTCTAACGTC
GAACCGGAAGCATTGCGCCAGAAGATCGCGATGGTCAGCCAAGAAATCCACTGCTTCCGA
GGATCTGTTTTAGATAATCTTCGTATCGCACGCCCCGAAGCCACCGATGCGGACATCCAC
GCCGTTCTCGCCGATATTGGTGATTCCTGGTTGGAGCGCTTACCGCAAGGCATAGACACC
ATCGTGGGTGATGGCGCTTTCCGTTTAACCTCTGTGGAAAACCAGATCATGGCGCTTGCT
CGCGTACATTTGGCCGACCTAGCAATCGTCATCCTTGATGAAGCAACGGCTGAATCAGGC
TCTGATCATGCAAAACAGCTTGAAGATGCAGCCCTTAAAGTCACTGAAAACAGATCAGCC
ATCATCGTGGCTCACCGCCTCAACCAAGCGAAAACCGCCGATCGCATCATCGTCATGGAC
TCCGGAGAAATCATAGAATCTGGAACCCATGAAGAGCTTCGAGCGATCGGCGGCCGATAT
GAACAACTGTGGACTGCGTGGTCTGCGCGC >RXN01191-downstream
TAATTAGCCACCCAAGACCACGC >RXN01212-upstream
TTTAGAAGCCACATGACATATGTCATGAAAATTATGTGCAAAGTGCAGTAATACTCCTGA
CATATGGCTCTACCAGCGCCAATGCGAAGTAGGAAGAATT >RXN01212
ATGCCTATGACAACGACACCAGCAATCGACGTAACAGACCTCGTGAGAACCTACGGCGAC
TACACCGCAGTCAAGGGCCTGAATTTCCATGTACAGCGCGGTGAAGTATTTGGTCTGCTC
GGCACCAACGGGGCCGGCAAAACCTCCACCTTGGAAGTCATCGAAGGACTTTCCGCACCC
AGCTCCGGCACCGTGCGCATCTCCGGGCTTGACCCCGTTGCCGACCGCGCGATCCTGCGC
```

Appendix A, page 99

Att Docket No.: BGI-125CP

```
CCCGAGCTCGGCATCATGCTGCAATCAGGCGGCCTGCCATCACAGCTCACCGTCGCCGAA
ACCATGGACATGTGGCACGGCACCTGCACGTATCCGCGCGCCATTAAAGATGTGCTTGCC
GACGTCGACCTCCTACACCGCGAAAACGTCAAGGTCGGCGCGCTTTCCGGAGGCGAACAA
CGACGCCTTGATTTGGCCTGCGCACTGCTTGGCGACCCCTCAATTTTGTTCCTCGACGAA
CCCACCACCGGCCTCGACCCAGAATCTAGGCGCCACACCTGGCAACTCCTGCTGGACCTG
AAACAGCGCGGCGTCACCATGATGCTGACCACCCACTACCTGGAGGAAGCCGAATTCCTC
TGCCACCGGATTGCCATCATGAACGCCGGTGAGATCGCAGTGGAAGGCACCTTGCATGAA
CTGGTGGCCCGCGAGAAGTCGATCATCAGTTTCGTGCTGCGTGGCGGGCAGGTGGAGTTG
CCGGTCTTGAGTGGGGCTGAAATCATCCGCGACAACAACCACGTCCGCATCGCCACCACC
ACCCTGCAGCAGCACACCTTAGAAATACTTACCTGGGCTGCAGAGACCGGGATCGCGCTG
GAAGGCTTCGCTGCAAAACCCGCCACCTTGGAATCCGTATTCATGGACATCGCCTCACTC
GAGAACACCTCGCTGCAAACCGCC

>RXN01212-downstream
TAGAATCTTTAAGGAGACCACAA

>RXN01285
CTCAACGTCACCATCCCCGACAACACCTTCACCGCCATCATCGGCCCCAACGGCTGCGGC
AAATCCACCCTGCTCCGCGGTTTCTCCCGCGTGCTCAATCCGCAGCACGGCAAAGTGCTT
CTCGACGGTCGGCAACTCGATTCATTCAAGCCTAAAGAGATCGCCCGAGAACTAGGCCTG
CTGCCACAGACCTCCATCGCCCCAGAAGGCATCCGGGTTTACGATCTCATCGCGCGCGGG
CGCGCTCCCTACCAAAGCCTCATACAACAATGGCGCACCTCCGACGAAGACGCCGTCGCG
CAAGCGCTCGCCTCCACGAATCTCACCGAACTTGCAGCTCGCCTCGTCGATGAACTCTCC
GGTGGCCAGCGCCAACGAGTGTGGGTGGCCATGTTGCTCGCCCAGCAAACACCGATCATG
CTTCTCGACGAGCCCACCACCTTCCTCGACATCGCCCACCAATACGAACTCTTGGAATTG
CTGCGCGCATTCAACGAGGCCGGGAAAACTGTGGTCACTGTGCTTCACGATCTCAACCAA
GCCGCCCGCTACGCCGACCACCTCATCGTGATGAAAGATGGGCACGTACATGCCACGGGC
ACACCGGAGGAAGTCTTAACTGCCGAGATGGTTCAAGGAGTTTTTGGCCTGCCCTGCATC
ATCTCCCCAGACCCCGTCACAGGAACCCCCACCGTCGTTCCCCTCAGTCGGTCTCGCGCA
GGAGCT

>RXN01285-downstream
TAAGTAGCTACCCCTCCAACGGA

>RXN01298-upstream
CTTAAACGTCACCTTATTTATGCATTATGTTGGTTTCAGACTCGAACAATTCAATTAGAA
AACACTAATCGGACATTTAGGTCACATAACATTTCCGCTC >RXN01298
GTGTCCACATTAATTTCTGAACCCGAGGTGGATAAGCTACGTAAACGTGCCAAGAGATCA
AGGCGGACAGAATGGTGGCTTGCCGCCGCACTTCTTGCCCCAAACTTGCTTCTCTTGGCC
ATCTTTACGTATCGGCCACTGTTAGATAACTTCCGGTTGTCCTTTTTCAACTGGAACATT
TCCTCGCCCACATCAACCTTCATTGGGTTTGATAACTACGTTGAGTTCTTCACTCGTAGT
GACACTCTCCAAGTTGTTTTAAACACCGTCATCTTCACGGCATGTGCTGTGATCGGATCG
ATGGTGCTCGGTTTGCTCCTGGCCATGTTGTTGGATCAGAAGCTTTTCGGCCGTAACTTT
GTGCGTTCCATGGTGTTTGCCCCGTTTGTGATTTCCGGTGCTGCCATTGGTGTTGCTTTC
CAGTTCGTTTTTGACCCTAATTTTGGTTTGGTTCAGGACTTGCTGGGACGCATCGGCGTT
GATTCGCCACAGTTCTACCAAAACCCTAACTGGGCATTGTTCATGGTGACGTTCACTTTC
GTGTGGAAGAACTTGGGCTACTCCTTTGTTATCTACCTGGCTGCATTGCAGGGGCTAAAC
AAGGATTTGTCTGAGGCCGCACCGGTGGATGGCGCGAGCGCGTGGACACGTTTTTGGAAG
GTTACTCTTCCGCAGCTTCGCCCAACCACGTTCTTCCTTTCTATTACTGTCACGCTGAAC
TCGGTTCAGGTCTTCGACATCATTCACACCATGACTCGTGGTGGCCCCTTGGGTAACGGT
ACGACCACCTTGGTTTACCAGGTGTACACCGAGACTTTCACCAACTATCGCGCGGGATAT
GGTGCAACAATCGCAACGATTTTGTTCCTGTTGCTGCTGATTATCACTGTTATCCAGGTT
CGATACATGGATAAGGAGAACAAGCAGAAA >RXN01298-downstream
TGATCTCGACTGATAGAAACGTT

>RXN01338
```

Appendix A, page 100

Att'  Docket No.: BGI-125CP

```
AAAACTTATACCCCAAATCCCTGGATGTTATTCATCCGCTCATTTGATGGCATCATCACT
GTCGCAGCCCTTGTTGCCATCGCAATACATCTCATTTTATGGCTGGCTCTAGATCTAGAT
GGCCTTGCTAAAAACTGGCCTTTAATAGCCATCGTTATCGTAGGTGGCATTCCGTTGATG
TGGGATGTGCTGAAATCAGCCATTAAAACTCGCGGTGGCGCGGATACTTTAGCAGCAGTC
TCCATCATTACTTCTGTGTTGTTAGGGGAGTGGTTGGTTGCCGCGATCATCGTGCTCATG
CTCTCTGGTGGTGAAGCGCTAGAAGAGGCAGCATCACGGCGAGCCAGTGGCACCTTGGAC
GCACTTGCCCGGCGCGCACCAAGTACAGCTCACCGCCTGTTGGGTGCAACCATTCTTGAT
GGAACCGAAGAGATCGCCGTGGAAGAGATCACGGTTGGTGATTTAGTGGCGGTGCTCCCG
CATGAACTTTGTCCCGTGGATGGTGAAATCGTGGCAGGCCACGGCACCATGGATGAGTCT
TATCTCACGGGTGAGCCCTATGTGGTGAGTAAATCTAAAGGTTCGCAAGCAATGTCGGGT
GCAGTCAATGGTGATACTCCGCTGACGATTGTTGCCACAAAGCTTGCCCATGATTCCAGA
TACGCCCAAATTGTTGGTGTACTCCATGAAGCAGAAAACAACCGCCCAGAAATGCGCAGG
ATGGCTGACCGTCTTGGCGCGTGGTATACGGTGATTGCACTTGCCCTCGGTGGTCTTGGC
TGGATTGTCTCCGGCGACCCAGTGAGGTTCTTGGCTGTTGTCGTTGTCGCCACCCCATGT
CCATTGCTCATTGCAGTGCCAGTGGCGATCATCGGTGCGATTTCTCTTGCGGCTCGTCGG
GGCATCATCGTGAAGAACCCTGGAATGCTGGAAAACGCTTCAGGAGTAAAGACAGTGATG
TTCGATAAGACTGGAACGCTCACCTATGGCAGGCCAGTGATTACTGATATCCACACTGCT
CCCGGAGTTGAGGAAGATACAGTCCTAGCTTTGGCTGCTTCAGTAGAGCGCTACTCCAGA
CACCCGTTGGCTGACGCGATTCGTGAGGGCGCAAAAGCCAGGGAACTTCATCTGCCTGAT
GTAGTGGAAGTATCGGAACGTCCAGGACAGGGACTAACCGGCACGGTGGGCGAGCACCTG
GTTCGAATAACCAATAGGCGCAGCACACTAGAAATTGATCGACAGCAAGAACTACATT
CCGGTGACAAGTTCCGGCATGGAATCTGTGGTGCTTGTTGATGATAAATATGCAGCACTC
ATTCGCCTCCGGGATGAACCTCGTGCATCTGCCAGTGAGTTCATCGCGCACTTGCCCAAG
AAGCACAAAGTGGACAAGCTCATGATTATCTCTGGTGATCGCGCATCTGAGGTTCGTTAC
CTTGCGGACAAGGTTGGCATTGATGAGGTACACGCAGAGGCCTCACCGGAAGACAAGCTG
AACATTGTTAATCGGCATAATGAGCACGGCGCCACCATGTTCTTAGGTGATGGAATCAAC
GATGCGCCAGCCATGGCCGTTGCCACCGTTGGTGTCGCGATGGGAGCAGACTCCGATGTC
ACGTCCGAAGCAGCAGATGCTGTGATTTTGGATTCTTCCCTGGAACGTCTCGACGATCTG
CTCCACATCAGTGCACGGATGCGTCGAATAGCGTTGCAATCTGCGGGCGGTGGCATGGCG
TTGAGTGTCATAGGAATGATCCTCGCGGTATTTGGATTCTTGACGGCACTGATGGGTGCG
ATCTTCCAAGAGGTCATTGACGTGCTGGCTATCCTCAATTCCGCTCGGGTCGCACTGCCA
CGCGGAGCGATTAGTGATTTTGATACGCAAGAAAAAGTTTCT

>RXN01338-downstream
TAGCAGGGTAACCTAAATGTCGT

>RXN01382-upstream
AAAGGATGTACCTCATGAGCACCACGATTACTCGCCGCAATTTCCTCCGAGCAACCGGAA
TCCTCGGTGTCGCAGCTGGCATCGGCGCAACACTTGCTGC >RXN01382
ATGTGCACCAACAACACCGGCACCAGCGGATCCACCTCCACCGCAGCTGGCACCGGAACT
GCAAATGAAGAAGGCACCATCACCGCAGCCATCTCCTACGAACTGGGAACCAACGGCTAC
GACCCAATGACCACCACCTCGGCTCTCACTGTGGCAGCCAACTGGCACACCCTTGAAGGC
CTCACCGAAATCGACCCAGCCACCGGCGAGGTCTACGCAGCACTCGCCAGCGCACTGCCT
TCAGCCGATGCGACCTCCCTAGACATCAAGCTTCGCGACGGCGCCACCTTCCACAACGGC
GACGCAGTCACCGCAGACGACGTAGTCTTCTCTTTTGAGCGAGTCCTCGATCCAGCCAAC
AACTCCCTTTACGCATCCTTCATCCCATTCATCAAGTCAGTCACCAAGAAGGATGACACC
ACCGTCACCATCGACCTCGACTACGCAACCGGCATCATCAGCGAACGCCTCGCAGTAGTA
AAGATCGTGCCAAAGTCCGTCGTGGAAGCAGACGCATCCGGATTCGACGCCAACCCAATC
GGCTCCGGCCCATACAAGATGACCGACAACGGTGCATCCAAGGTGGTCAAGTTCGAGCGC
AACGACGACTACAACGGCCCACGCCCAGCACGTGCCGCCAAGATGGAATGGCAGATCATC
CCCGACGCCTCCACCCGCACCAACTCCCTTCAGTCCGGCAGCACCATGGCCATCGACTCC
GTTCCATACCTGTCGATCCCACAGCTTGAAGCCACCAGCACCGTAGAATCCGTCCAAGGA
TTCGGCCTCCTGTTCGCCATGTTCAGCTGCTCCGAAGGCAACCCCTTCAACGACGTCCGC
AACCGCCAGGCATTCCTCTACGCACTGGACATGGACAAGATCGTTAAGACCGGCATGTCC
GACCAGGCAACCCCAGCCACCTCCTTCGTGCAGAAGGAACACCCCAACTACAACCAGGCA
TCCACGGTCTACTCCCTCGACGCCGACAAAGCCAAGGCGCTGTTCGCTGAAACCGGCCTT
ACCAGCCTCAACCTCCTGTGCACCGACCACGACTGGGTCAAGAACTGCACCCCACTGATC
CAGGAATCCCTC
```

Appendix A, page 101

Att    Docket No.: BGI-125CP

>RXN01411-upstream
CTTATCGACGTCCCCATCCCCCTCGCCAATGCTTCGGCGAGGGGTTCTATTTATTGTGTG
TGCTAGCCTTTTCGCAATCGTTCAGCCCGCCCCGACGTCA >RXN01411
ATGTTGGGAGTGGGCTGGCGCATTCCATTCCTGATGGCCGTGCCACTAGGGCTTATCGGC
TGGTGGATCCGCACCGGTGCCCAGGAAAATGTACGCCCCGCATCCGAACGCCCCGAAGCT
CCTATTAAGCAGGCATTGCGTACTGAGTGGAAGATGATGTTGCGGGTAGGTGGCTTTATC
TCTTGCACCGGTCTGAGCTTCTACATTTTCACCACGTACATGACCACTTTCCTGCGCAGC
ACCGTCGGACTGGAGGGCACGTTAGTGCTGGCTGGAAACATCATCGCTCTCAGCATGGCA
GCAATTGTGGCCCCATTTGTTGGCCGCGCAATTGATAAATTCCCCCGCCGGAACATCATG
GCTTTCGCTACCTTAAGCACAGTAATTATGGCGATCCCGGCCTACATCATTGCAGGTCAA
GGTACTTTGACTGCTTCTTTGATTGCGCAGGTAATGCTTGGAATCGGCGCGGTTACCGCT
AACTGCGTTACCTCAGTAATGATGGCCGAGGTCTTCCAAGAGGTCACCCGCGGTACTTCC
GCCGGCATTACCTACAACGTCACTTACGCAATCTTCGGCGGCTCGGCTCCATTTATCTCC
ACCGCATTGGTCTCCTGGACCGGCAGCCCGCTGGCCCCTGCGGTATACATGATCATCATT
GCGCTCTTCGCCTTCACCGCGTCCCGCTTCATTCCTGAAACCTCCCCAGTTTTTGTCACC
GCAACCCCGGCCATTAAGGCACCAAAGGTGCTGGTCAACCCGGGT >RXN01411-downstream
TAAACCACGCTTTTCGACGAAAA >RXN01421-upstream
TTGATGCACGTGCAGAAATCGTCGGCGGTCCGTGGCACCCATCTGTTAAGGGAGACTCGG
TTACTGCAGGGATCCTGCGAGATCGAGTAAACGCCTAAAG >RXN01421
ATGACGTCGAAAAGCATTAGCGGCAAGCGCCCGAATCTGCCGTCGCTCACTGGAGCGCGG
TGGCTCGCGGCGCTCGCTGTTTATTTTTGCATGCGTTGGTGTTTTTGTCGGTGTATCCG
TTCCAGCAGTCGGAACTGTTTGCCACAATCCATAAATTTGTCCCCATGCAGCTGGGTTCA
GCTGGTGTAACCTTCTTCTTTATCTTGTCCGGATTTTTGATCTATTGGTCAAATAGCCAG
CTCAAGGGCATGAAGAATGTGCTGTATTACTGCAAGCGCCGCATCACCAAGATTTATCCC
ATGCACTTGATTGCGTTGCCGATGTTTATTGAGGCGTCGGCGAAGTTCACGACTACAGGC
ATTACCTGGGTGCTGATTTTGCGCGAG >RXN01421-downstream
TAAAGCTGTGGCTGCGGAATGCG >RXN01602-upstream
TGCAGGCCACATGCCTCCCAGTGCCGTCTCTGCACGTTGATTTTCCCCTGCCACGACTGG
TCGCAGGGCGACTTTCTAGCACTTTTAAAGGAATTTTTTA >RXN01602
ATGGCTAAAACCCATATTCGGTTACAGGACCTTTCCCTGTCATACACCTCAACCCCGTTA
ATTACGAAGCTCAATATCACTGTTTCTTCTGGACAGTGCGCAGTGATTGTTGGTGAGAAT
GGTCGAGGTAAAACCACACTTCTGCGAGCACTGGCTCGAGAATTCCCGCCATCTGCAGGT
GAGATTCTCACTCATGGCACGGTAGCAATTGCTCATCAACACATGCCTGCAGGTGATCTG
TCCGTCGGAGAGATCTGTGATGAGGCAATTCGTGATTCAAAGAATGCTCTCGAAGAGCTT
GAGAGAGCTGGAGCTCTACTTGAGACAAAACACTGCGCACGCACTTGATGGATATCAACAA
GCCCTTGATGCCGCTGAAGTGCTTGACGCATGGAACGCTGAACATCGATTAGAAAAAGCT
CTGCGCAGCTTTGGCGCGATCACCGATAGATCCCGTGCACTCAGTGAGCTATCGATCGGG
CAAAGGTATCGGGTACGGCTGGCCTGCCTCATCGGTGGCGATGCTGATATTTTGCTTCTC
GATGAACCCACCAATCATCTTGACCGGGGCGCGCTTAACTATCTCACCGAAGCCATAACC
TCCCACAAAGGTGTGGTACTTGTTGTTTCTCATGATCAAGCACTGATCAAAGATGTCGCG
GATTTCATCATCGATATTGATTCAACCCCAGACGGCCTACCACGGATCTATCATGAGGGT
TTTGATTCTTATCGACGCCAAAGGAGTGCGCTTCTTGAAACTTGGAGGCAGGATTATGCC
GCTGCACAAACTGTGCAACAGCAATTGCAGGAGGATCTAGAGCACGCACGCCAGCGGGTG
AATTCTTCGTGGAAACCTCCAAAAGGAACGGGAAAACACACTCGCGCATCTCGGGCTCCC
GGAGTGGTGCAGGCCTTAAAGCGAGCACAGGATGCGTTGGATAGCAAAGCGTTGGACGTT
CCCCCGGCTCCGGCCCCATTGCTTCTGCCTACCTTGAAAGTGCGACCAGATAAACCCATG Appendix A, page 102

Attorney Docket No.: BGI-125CP

```
GTGGACTTTTCGGACCTTTTTGTACCCCACCGCTTGCGTCTGCCAGGCTCACATTCAGTG
GTATCAGGTGACAAAATAGTGATCACTGGTGACAACGGCGCTGGCAAATCAACGCTCATC
GAAGTCTTGTCTGGGGTTTTGACTCCGGCAAGTGGTTCGGTTGCAAACCATGCCCGAACT
GGGGTTCTCGGCCAAGAATCACTTGTCGGCGAGGTGCCATCAATAGCACGAGATCACGCA
GTTAAGTGGGGACTTTTAAGTGTTGAGGAGAGCCGATTTGCCCTACAGGAATTCTCAATT
GGTCAACGCAGAAGACTAGATTTGGCCATGTCGTTAGCTGGCAATCCTGAACTGTTGCTT
CTCGATGAACCTTCGAACCATCTGTCTATGCACTTGGTTTCCGCACTTACAGAGTGGCTG
GACACGACCGCGGCTGCAGTGATCATGGTAACGCATGATCGACAGCTACTCCGCGATACG
GCTCATTGGAGGCACATCGAGTTGAAATCT

>RXN01602-downstream
TAAGAATTCGCAAGGGCTTTCAC

>RXN01604-upstream
CTCTCATGTTGTTGTCCTCTAGTTGACAGCGGGGGTGGTGGTGGTCCTAAAATAGCCTAC
GATAACTGATAGTGTTTCCTCCACTTACGGAAGAAGATAC >RXN01604
ATGAATACCCCTCTTTTGAGAAGCTCTGGGCTCTCCATCCGCGACACACCCTTCGCCGAT
GTTGAGATAGCTCCAGACAGCGGACTCACTTTGCTGAGCACCGGGCGCGAATCCCAATCC
AGTTCCTTTTCTTTGGTACTTTCCGGCCGCATGCGCGCCTCCACCGGAACCATCGAATTA
AACGGCGAACCCATCAAGGCAACCAAGCTGGCCAAGCATGTGGCTTTGGCGGGCATCCCT
GAAATCGATTCACTCGAGCGACTTGTCACTGTGCGCACCGTTGTCCGTGAACAACTCGCC
TGGTCAAGCCCTTGGTACCTGATGGTGCCCAGGGATATTAGTGATTCGGGACGGTGGGTT
GACGTCGAAAAGCATCTTGGCCTGAACCTGAACCCTAAAACCTTAATCGGCGACCTCAGC
GTGCTCGAGCGTTTTAAGCTGCGCATCGCGCTGGCGCTGCTGGCGCGGCCAGAGGCGCAA
CTGTTGGTCGTGGATGATCCCGATCAAGTGCGCAGCATGAATTGCGTGCGGAGGTGTTG
CACGCATTGAAAGGCGTTGCAGAGGATCTCCCTGTGGTCGTGGTATCCACCAACCCAGAT
TTTGATTCCTTGGCCGATACCGCTTTGACCATTACGGGGGCTGGAAAC >RXN01604-downstream
TAATGGCATTTTTACACTTTGGC >RXN01722-upstream
CTCATTCCCCTCGCTAAAAGCTGCATAAAGTTTCGACGTTTTCAAAGTTGATTGCTTGCA
CTGTCGTTGCGTGTCGCATGCCCCGGCTATTGTTGATTGC >RXN01722
ATGCTCAGCACGATGCAGGACGTCCCACTGTCATTAACCAGAATCCTCGAGTACGGGTCC
ACTGTTCACGGTGATACTTTGATCACCACGTGGGGCGGTGCCGATGGCATTGAACAAGCA
CAGCAAACTTTTAGTGCTGTGGGGGCAGAGCTGCGGCTTTGGCTCATGCGCTGCATGAT
TCTTTAGGTATTACTGGGGATCAGCGAGTGGCGTCGATGCTCTATAACTGCGCGGAACAC
ATGGAAACTATGTTTGCAGTCGCATGCATGGGTGCCGTGTTTAATCCGCTGAACAAGCAG
TTGATGAATGATCAGATTGTGTTCATTCTCAATCACTCTGAAGCTGAAGTGGTTATCGCT
GATCCGCGCATGGCTGAACAATTGGGTGAGATCTTAAAAGAAACACCAAAAGTTCGTGCC
GTGGTGTTTATTGGACCGAATGATTTCTCTAGCGCGGCGGCCCACATGCCGGAGGGAATG
AAGCTGTATTCCTATGAAGCGCTCCTTGACGGCCGTTCCACTGTTTACAACTGGCCCGAG
CAGGATGAACGCACTGCTGCTGCAATTGCTATTCCACCGGTACATCGGGACCGCCGAAG
GGTGTGGTGTATTCCCACCGCTCGCTTATTTACAGTCGTTGAGCTTGCGCACCACGGAT
TCCCTCGCAGTGGAACACGGCGAAACGTTCCTGTGCTGTGTGCCGATTTACCACGTCCTC
AGCTGGGGCGTGCCGATCGCAGCGTTTATGTCCGGCACTCCCCTGGTGCTTCCTGGACCG
GATCTTTCTGCGCCGACATTGGCAAAGATCATTTCCACCACGCTGCCTCGCGTGGCGCAT
GGCGTGCCTACTCTCTGGATTCAGCTGATGGTTCACTACCTGAAAAATCCCCCAGAGCGT
ATGTCTCTGCGTGAGCTATACGTGGGCGGTTCTGCGGTGCCTCCAATCGTGATCACCATG
TGGGAGCAGCGCTATGGCGTGGATGTTGTCCACGTGTGGGGTATGACGGAAACCTCCACC
GTGGGTACTGTGTCTCGCCCACCATCAGGTGTTTCTGGTGAAAGCCGGTGGAATTATCGA
GTCTCCCAGGGCCGATTCCCCGCCTCCCTGCAGTACCGCATTGTCAACGACGGCCAGGTC
ATGGCGTCCACCGACCGCAACGAGGGCGAGATTCAGGTCCGCGGTCCGTGGGTGACTGCA
AGTTACTTCCACCCCGATGTGGAAAAAGAAGGTGGCACCGCCTCAACATTCCGCGACCAT
GACGTTGAAGAGGAAAACGATGAGCTCTTCACCGCCGACGGCTGGCTGCGCACCGGGGAC
GTTGGATCTGTCACCAGCGATGGATTCCTCACCATCCAAGACCGCGCCCGCGATGTCATC
```

Appendix A, page 103

CGTTCTGGCGGCGAGTGGATTTACTCCGCTCAGCTGGAAAACCTCATCGTGGCTACGGAA
GAGGTTGTCGAATGCGCCGTCATTGGCTTCCCCGATGACAAGTGGGTGGAACGTCCCCTC
GCAGTCACCATGCTCTACCCCGGCATTGAACGCACCCGGGAAACCGCCGAGCGCCTCCGC
GATCAACTTCGCGACCGCCTACCCAACTGGATGCTGCCAGAATATTGGACATTTGTTGAT
GAGGTGGATAAAACCTCCGTCGGTAAATATGACAAGAAGGACCTCCGCAACCACCTGCGC
AACGGCGATTTCGAAGTAATTAAGCTTAAAGGGCCAGGTGAAAAA

>RXN01722-downstream
TAACTTCCCTATTTATTCCGGCT

>RXN01732-upstream
GATTCTATCGCTGATCTCCCTCTCCTTGCCTGGGTTTGTTCCCGGGTCTCCTCTTCTTAA
CTTTCTTGTCTCATGTCGCTGAAAGGTTTTTAAAGATCTC >RXN01732
ATGTTCAAGCTCTCTAAGCCATCCAAGTCCATGCGTGTTGCTGTTTCTACGCTTGCGATC
TCTACCCTTGCTCTAGTTGGTTGTTCCTCTTCCGATGAGTCTTCTTCCTCATCATCTGCG
TCTTCTTCTTCGGATGCTGCAAGCCAGTGGCCTGAGTCCATTACTTTGTCTCTTGTTCCT
TCTACTGAGGGTGAGGATTTGGCTGAAGCGTTGGCTCCTTTGACTGATTACCTGTCTGAG
AACCTTGGTATTGAGGTCAATGGTGTGGTGGCGTCTGATTACGCTGCAACCGTTGAGGCT
TTGGGTGCTGATCAGGCTCAGGTGATCATCACTGATGCGGGTTCCCTGTATAACGCGATT
GAGCAGTACGATGCGCAGCTGATTCTGCGTGATGTGCGTTTCGGTGCCACCTCGTACTCT
GCTGTGGCGTACACCAACAATCCTGATAAGTACTGCGACGATGCCCCAGTGGCTGCGTCT
TATGCTGCGTCCGATGTAGACATGCTTTACTGCAACGGTATTGAAACTGAGGGCCAGGCT
GCTACCGGTGAGGGCCCAGCAGCTCTTGATGCGCTGGAAAAGATCGAGTCCGGTGACAAG
GTAGCGCTGCAGGCTGCAACCTCTCCTGCGGGTTACCAGTACCCTATCGTCGCTATGCAG
GATCTGGGCATGGATACCGATTCCGCTTTTGTTCAGGTTCCAGTAGAGGGCAACAACAAC
GCTGTGCTGTCTGTCCTGAACGGTGACGCGGAAGTGTCCTTCGGTTTCTGGGATGCGCGT
TCCACCGTGCTGTCTGAGGCTCCTAACGCAGCTGAGGATGTCGTAGCGTTTGCCTACACC
GAGATGATCCCTAACGGTGGCGTCGCAGCGTCCAAGTCCCTTCCATCCGACCTGGTGGAA
AAGCTCACCGAGTTGATGGATGATTACGCAGATTCCTCCGAGGAAGCCAAGGATGTCATG
TTCGACATGGTTGGTCTATCTGACTGGACTGCTGATACCGCACAGGATGAAATCACTCGT
TACGGCGAGATCCTGAAGAAGTTCTCCAAC >RXN01732-downstream
TAATTTCCCTGTTTCCAATACTC >RXN01762-upstream
TGGAGTGATGAATTTTCCTATAGAACGTTTTTTAAACGATTGACTTTTTAAACGTTTACG
CTTTTAATGACTTCAAACGTGATCTAAAGCACAAAGGAGA >RXN01762
ATGAAAGTGAACCTCGGAATAGGAAGCTACCCACGACGCAGGGCAACTGTTCGACCAGAG
TCCACTGCAATCGAATTCGAAGGCACCAGCATCACCTACGGGAGAATTCAGCAAACGAGTC
AATCGGCTTGGACATGCTCTTCTAGACCTCGGCGTTGCGCACCAAGATCGAGTAGCTTAT
GTCGGATTCAACCACCCTGCCCTGCTAGAAGTGTTCTTTTCAACGAACCTCATTGGGGCA
ACACCCGTGCTTGTTAACCCTCGCCTATCGGCAAACGAAATCGATTACATCATCCAAGAC
AGCGGTGCGAGCATCGTGTTTTACGGAATCGACCTCATCGAGCACGCCACTTACCTCCAA
GAACTCCATCCAGAGATCATCATGGTGGCCGTTGAAGGCGATGAGGGTCCAGGTTTGCGT
CGAAAAGCGCTTATTGAAGCGGCGAGCGACGCCGACATCGACCTAGAAGTCAGCGATGAT
GACCTGGTGCTGCTCATGTACACCTCCGGAACCACTGGCCGCCCAAAGGGCGCCATGTTA
TCCCACCGAAACCTCTTCTTTAACTACTTCAATGCCCTGCTCAGCCAGGAAATTGAACAA
GGCGCGGTACTTTTATCCACTGCGCCGTTATTCCACATCGCGGGCCTCAACATGACCACC
ATCCGGTGATGATGAAGGGCGGAAAGGTGATCATCCACCGCGAATTCCGGGCAGAGCAC
GTCCTCGACGAAATCGAACGCTCCAAGGTATCCGAATCCTTCATGGTGCCAGCGATGATC
GACATGTTGTCCAACCACCCATCATTTGCCGAACGCGACCTTTCTTCCCTTCGCGCCATC
ATGGTGGGCGGCTCTCCCCTTAGCGAACGTGCGCTGCGAATCTGGCAAGGACGCGACGTA
AAAATTGTCCAAGGCTTCGGCATGACAGAAACCGCACCGGGCGCCTGTATCCTCGAGGCA
ACAGACACAAGCACACACCTTGGAACCGCAGGTCGAGCCCACTTCTTCACCGACATCAAA
CTAGTGGACCCGAAAACCGGCGAAGAAGTCCCCACCGGAGAGGCCGGCGAAGTTCTCATC
CGCGGACCACATGTGATGACCGGATACTGGAACCGACCAGAAGACACCGCCAGCGCACTA Docket No.: BGI-125CP

```
CAAAATGGCTGGTACCACTCCGGAGATATCGCCATCAAAGATGAAGACGGCTACTACACC
ATCAAAGACCGCATCAAAGACATGTACATCTCCGGCGGCGAAAACATTTACCCCGCAGAA
GTCGAACAAGCACTCCAGGAACTGGAAGCAGTCCTTGATGCCGCAGTCATCGGAGTCCCC
GATGAACGATGGGGCGAAACTGGCATCGCCTTTGTCTCCATCCGAGAAAGCTACCTGACC
AACCCACCAACCGGACCGGAACTACGAGAACTACTAGGCAGTGTCCTAGCCAGATACAAA
CTTCCACGAGAAATCCACATCATCGAAGAACTCCCCCGCAACGCCACAGGCAAAATCCAA
AAGAACATCCTGCGAGACTTCACCATCCCCGTTTCA

>RXN01762-downstream
TAAACCCCCCAACGTCACTTTGA

>RXN01881-upstream
ACCGGCCCTGCGGCCTCAACCGCCGACCAGCGCGGCGCACACATTTTGACTGTTTCATAA
TAAAGACAAACTTAAGTATCGGAGTCGAAGAAAAACCACA >RXN01881
ATGGCCAATCTGATTAATCTCGAGAACGTCTCCAAAACCTGGGGATTAAAAACGCTTCTC
GACGGTGTCTCCTTAGGTGTTCAAACCGGCGACCGCATTGGCGTCGTCGGCCTCAATGGT
GGCGGAAAAACCACCCTGCTGGAAGTACTTACTGGCATCGAAAAGCCGGATCAGGGCCGT
GTGTCTCACAACTCTGACCTGCCGCATGGCTGTGGTGACGCAGCGTGCTGAACTCAATGAT
GACGACACCGTCGCTGACGTGGTGCTTGGACCTTTGGGTTTGGAAGTTTTCGAATGGGCA
TCAAACGCCACGGTGCGCGACGTCCTCGGTGGCTTGGGCATTGTCGATCTTGGCCTTGAC
ACCAAGGTGGGCAAACCTTTTCCGGTGGGCGAAGCGCCGACGCACCAACCTGGCCGCCGC
GCTGGTTCGCGACCT >RXN01881-downstream
TGACCTGATCGTGCTCGACGAGC >RXN01936-upstream
GCGCGGTGACACCACAGCCGTTGTCAGCGGCGCTTGGTCTGTGGAGGATCGCCGAGGTTA
CTAACAAATAGGCCCAACAAAGAGGTCTAAGCTCTACCTG >RXN01936
GTGAGTTTCCGAGATATTTTCGCTGACACCAGACCGCTGAAAGAACCGGCCTTCAAACGC
CTCTGGCTTGGCAATGTTGCCACCGTCATTGGTGCCCAATTAACTGTTGTTGCCGTTCCG
GTGCAGATTTACCAAATGACTGGGTCCTCCGGCTATGTGGGCTTGACCGGGCTTTTTGGC
CTTATTCCTTTGGTTATTTTTGGCCTTTATGGTGGATCCATTGCGGATGCTTTTGATAAA
CGCATCGTGCTGATCTGCACCACGATCGGCATGTGTGTCACCACTGCCGGTTTTGGGTG
CTGACCATTTTAGGCAATGAGAATATTTGGCTCCTGTTAATAAACTTTTCTTTACAGCAG
GCATTTTTCGCGGTGAATCAACCCACCCGAACGGCGATCCTTCGAAGTATTTTGCCGATT
GATCAATTAGCGTCGGCAACATCACTGAATATGCTGCTCATGCAGACCGGCGCAATCGTT
GGCCCGCTGATCGCAGGTGCGTTGATTCCGCTGATCGGTTCGGGTGGCTGTATTTCCTT
GATGTTGTCTCCATCATCCCCACACTGTGGGCTGTATGGTCACTGCCTTCGATCAAGCCA
TCCGGCAAGGTGATGAAGGCTGGTTTCGCCAGTGTGGTGGATGGCCTGAAGTATTTGGCT
GGCCAACCCGTGTTGTTGATGGTGATGGTGCTGGATCTTATCGCCATGATTTTCGGCATG
CCACGTGCGCTTTACCCCGAGATCGCAGAAGTGAACTTCGGTGGGGGTGACGCCGGTGCA
ACGATGCTGGCGTTCATGTACTCATCCATGGCTGTTGGCGCAGTTCTTGGCGGCGTGCTG
TCTGGTTGGGTGGCCCGGATTAGCCGCCAGGGTGTTGCAGTTTATTGGTGCATCATCGCC
TGGGGCGCAGCCGTTGCTTTGGGTGGTGTGGCAATTGTTGTCAGCCCCGGCGCGGTGACT
GCGTGGGCGTGGATGTTCATCATCATGATGGTCATTGGTGGCATGGCTGACATGTTCAGC
TCGGCAGTTCGAAACGCTATTTTGCAGCAGTCTGCTGCGGAACATGTGCAGGGCCGAATC
CAAGGTGTGTGGATCATCGTCGTGGTGGGTGGACCTCGTTTAGCTGACGTCCTTCACGGT
TGGGCCGCTGAGCCCCTCGGCGCAGGTTGGACGGTATTATGGGGCGGAGTAGCGGTGGTT
GTACTCACTGCAATTTGTATGGTGGCCGGTGCCTAAATTCTGGAAATACGAGAAACCAAAA
ATTACCGGCATC >RXN01936-downstream
TAAATACTTATCCATGCCCATTT

>RXN01946
ATCCGCAAGTACTCCAGGCTCGAGGAACAATTCCAGTCGCTCGGCGGCTACGAAGCTGAC
```

Appendix A, page 105

Attorney Docket No.: BGI-125CP

```
GCCGAAGCAGCCCAGATCTGCGACAACCTCGGCCTCGAGGCACGCATCCTCGACCAGCAG
CTTAAAACCCTGTCCGGCGGCCAGCGCCGCCGCGTCGAGTTGGCGCAGATCCTCTTCGCC
GCCACCAACGGCTCCGGCAAATCAAAAACCACATTGCTTCTCGACGAGCCCACCAACCAC
TTGGACGCAGACTCGATCACCTGGCTCCGTGACTTCCTGGCGAAGCACGAAGGTGGACTG
ATCATGATTTCGCACGACGTCGAACTGCTTGGCGCCGTATGTAACAAGATTTGGTACCTC
GACGCAGTACGCAGCGAAGCCGATGTCTACAACATGGGCTTTAGCAAATACGTCGATGCA
CGTGCACTCGATGAAGCACGCCGACGCCGTGAGCGCGCAAACGCCGAAAAGAAGGCCGGA
GCCCTCAAGGACCAGGCTGCACGCCTCGGCGCGAAAGCAACCAAGGCTGCCGCAGCTAAG
CAGATGATCGCCCGTGCGGAACGAATGATCGACAACCTCGACGAAATCCGCGTAGCTGAC
CGCGCCGCCAACATCGTTTTCCCAGAACCAGCACCCTGTGGAAAAACCCCACTCAACGCC
AAGGGCCTGACCAAGATGTACGGCTCCCTCGAAGTCTTCGCCGGCGTCGACCTAGCCATC
GACAAAGGCTCCCGCGTAGTCGTCCTCGGATTCAACGGTGCAGGTAAAACCACCCTGCTC
AAACTCCTCGCCGGTGTGGAACGCACCGACGGCGAAGGCGGCATCGTCACCGGATACGGC
CTCAAAATCGGCTACTTCGCCCAGGAACACGACACCATCGACCCCGACAAATCCGTCTGG
CAAAACACCATCGAAGCCTGCGCCGACGCCGACCAACAAAGCCTCCGCAGCCTCCTCGGA
TCCTTCATGTTCTCCGGCGAACAACTCGACCAACCAGCAGGAACACTCTCCGGCGGTGAA
AAAACCCGCCTCGCACTGGCCACCCTCGTGTCCTCCCGCGCAAACGTCCTGCTTCTCGAC
GAGCCCACCAACAACCTTGACCCGATCTCCCGCGAACAGGTCCTCGACGCACTGCGCACC
TACACCGGCGCAGTCGTCCTGGTTACCCACGACCCGGGTGCAGTCAAGGCCCTTGAGCCA
GAACGCGTCATCGTGCTTCCTGATGGCACCGAGGATCTTTGGAATGATCAGTACATGGAA
ATCGTGGAATTGGCG

>RXN01946-downstream
TAGGTTCTAAGGCTGTTTATGCT

>RXN01995-upstream
CCGACGCAAAGGCATGCGCCTGCGTGTCTCGAGTAGTCTCCTCCCCTTCCTCGTCCCCAA
CCTCGACCATTACGGTCGCCCTCTCCTAAAGGAGCCTGGC >RXN01995
ATGGATATCCGCCAAACAATTAACGACACAGCAATGTCGAGATATCAGTGGTTCATTGTA
TTTATCGCAGTGCTGCTCAACGCACTGGACGGCTTTGATGTCCTCGCCATGTCTTTTACT
GCGAATGCAGTGACCGAAGAATTTGGACTGAGTGGCAGCCAGCTTGGTGTGCTGCTGAGT
TCCGCGCTGTTCGGCATGACCGCTGGATCTTTGCTGTTCGGTCCGATCGGTGACCGTTTC
GGCCGTAAGAATGCCCTGATGATCGCGCTGCTGTTCAACGTGGTGGGATTGGTATTGTCC
GCCACCGCGCAGTCCGCAGGCCAGTTGGGCGTGTGGCGTTTGATCACTGGTATCGGCATC
GGCGGAATCCTCGCCTGCATCACAGTGGTGATCAGTGAGTTCTCCAACAACAAAAACCGC
GGCATGGCCATGTCCATCTACGCTGCTGGTTACGGCATCGGCGCGTCCTTGGGCGGTTTC
GGCGCAGCGCAGCTCATCCCAACATTTGGATGGCGCTCCGTGTTCGCAGCCGGTGCGATC
GCAACTGGTATCGCCACCATCGCTACTTTCTTCTTCCTGCCAGAATCCGTTGATTGGCTG
AGCACTCGCCGCCCTGCGGGCGCTCGCGACAAGATCAATTACATTGCGCGCCGCCTGGGC
AAAGTCGGTACCTTTGAGCTTCCAGGCGAACAAAGCTTGTCGACGAAAAAAGCCGGTCTC
CAATCGTATGCAGTGCTCGTTAACAAAGAGAACCGTGGAACCAGCATCAAGCTGTGGGTT
GCGTTCGGCATCGTGATGTTCGGCTTCTACTTCGCCAACACTTGGACCCCGAAGCTGCTC
GTGGAAACCGGAATGTCAGAACAGCAGGGCATCATCGGTGGTTTGATGTTGTCCATGGGT
GGAGCATTCGGCTCCCTGCTCTACGGTTTCCTCACCACCAAGTTCAGCTCCCGAAACACA
CTGATGACCTTCATGGTGCTGTCCGGCCTGACGCTGATCCTGTTCATTTCCTCCACCTCT
GTTCCATCCATCGCGTTTGCCAGCGGCGTTGTCGTGGGCATGCTGATCAATGGTTGTGTG
GCTGGTCTGTACACCCTGTCCCCACAGCTGTACTCCGCTGAAGTACGCACCACTGGTGTG
GGCGCTGCGATTGGTATGGGTCGTGTCGGTGCGATTTCCGCGCCACTGCTGGTGGGTGGC
CTGCTGGATTCTGGCTGGTCCCCAACGCAGCTGTATGTTGGTGTGGCAGTGATTGTTATT
GCCGGTGCAACCGCATTGATTGGGATGCGCACTCAGGCGGTAGCCGTCGAAAAGCAGCCT
GAAGCCCTAGCGACCAAA >RXN01995-downstream
TAGGGCCGCGATTCCTAGCATGC >RXN02062-upstream
TTGTCTAAACATCGTTTTGGGGTCCGAATGATAGCCCCTTTTAATGCCCCCATTTCGGTA
TCGCTGCGCAACTGTTTTTAGATGGCTAATCTTTGAAATT
```

Appendix A, page 106

Attorney Docket No.: BGI-125CP

>RXN02062
ATGAGAGTCGGAATGATGACAAGAGAGTATCCACCAGAGGTTTACGGCGGCGCTGGCGTG
CACGTCACCGAATTGACCCGATTCATGCGTGAGATCGCTGAAGTTGATGTTCACTGCATG
GGTGCACCTCGCGATATGGAGGGAGTTTTCGTCCACGGCGTCGATCCTGCCTTGGAAAGC
GCGAACCCTGCGATTAAGACACTGTCCACCGGTTTACGCATGGCAGAAGCTGCAAACAAC
GTGGATGTCGTGCACTCACACACTTGGTATGCAGGTCTTGGCGGCCACCTTGCAGCTCGT
CTCCACGGCATTCCTCACGTGGCTACCGCGCACTCTTTGGAGCCAGATCGCCCATGGAAG
CGTGAGCAGCTTGGCGGTGGATACGACGTGTCCTCCTGGTCTGAAAAAAATGCCATGGAA
TACGCTGACGCGGTCATCGCTGTGTCGGCTCGCATGAAAGATTCCATCCTCGCTGCGTAC
CCTCGCATCGAGCCGGACAACGTGCGTGTTGTCCTCAACGGCATCGACACTGAGTTGTGG
CAGCCTCGCCCGACTTTCGATGACGCGGAAGATTCCGTACTCCGCTCCCTAGGCGTTGAC
CCACAGCGGCCCATCGTCGCATTTGTCGGCCGCATCACCCGCCAAAAAGGCGTCGAGCAC
CTCATCAAGGCAGCAGCGCTTTTCGACGAGTCCGTGCAGCTTGTGCTCTGTGCCGGCGCG
CCAGACACCCCCGAAATCGCAGCTCGCACCACCGCCCTGGTGGAAGAACTCCAGGCAAAG
CGCGAAGGCATTTTCTGGGTTCAGGACATGCTGGGCAAGGACAAAATCCAAGAGATTCTC
ACCGCTGCTGACACCTTCGTGTGCCCATCCATTTACGAGCCACTGGGCATCGTGAACTTG
GAAGCAATGGCCTGCAACACCGCAGTTGTCGCATCCGACGTTGGAGGCATCCCTGAGGTT
GTTGTCGACGGCACCACCGGCGCCTCGTTCACTACGACGAAAATGATGTCGAAACCTTC
GAGCGCGATATCGCCGAAGCGGTGAATAAAATGGTCGCTGATCGAGAGACCGCAGCCAAA
TTTGGTCTCGCAGGGCGCGAACGTGCTATCAATGATTTCTCCTGGGCAACGATTGCTCAG
CAGACCATTGATGTGTACAAATCCTTGATG

>RXN02062-downstream
TAAAACCGAAAGCCGGGGAACCT

>RXN02074-upstream
CGGGGGAAGGCCGTGTCGCATGCTCGGGCTAGCCTTGGATCTCAAGAAGAATTCGACTGG
TTTAAAGTCTGGGCTTTAAGTGCAGAAAGGTTGTGGATTG >RXN02074
ATGCGCTCCCTGCTTCGTGATATCCCTGCCGGTGGGTTGGCTAATCACCGCGACGATTGTT
GTGCGCACGCTCGTTGTTGCGCTGGTCATCGTTGGGATCGGCTTGCTTATCGACGTCCCC
TCGCCCGCTCATTCAGCCATGTTGTGGTGGGTTCTGGCAGGTGCCACGGCAGCAGCTGCG
CTGCTGTGCGCGGAAGCGGTGCTCCCCAACGTATTCGTGCACGAGTTGAACGATCCTGG
CGGCGGCAGTTGGCTGCTAAAAATCTGGAGCTGAATTCCAGTTCGTCAGATGATGCCCAG
TTGATCACACTGGCAACTGAAGCCACCTCAAAAGCATCCACTTACACAGTGATGTTTCTG
GGGCCTTACTTTGCAGTATTTTTGGCCCCACTGACAGTTATTGCCGTTGTCGGCGCGGCT
ATTTCCTGGCCGATTGCGGGGATACTGTGCCTCGGGTTGTGCGTGATACCTTTCGTTATT
TCTTGGGCACAGCGCATGTTGAAAGGCGCTGGCGCGGGATACGGGCGAGCATCTGGGCAG
TTGGCAGGCGTGTTTTTGGAATCGGTGCGCACACTAGGCACCACGATGATGCTGAATGCC
GCTGGGCAGCGCAGGCAGATCATCACACAGCGCGCAGAGAATATGCGCTCCCAAGTGATG
TCATTGCTGTACCGAAATCAGTTGATGATTCTGGTGACCGACGGCGTGTTTGGAGTTGCC
ACCACAATGGTTGCTGCGGTGTTTGCCATTGGAGGATTCTTTTCAGGCTCTCTTACTCTC
GGCCAAGCTGTAGCACTCGTATTGCTGGCCAGGCTGCTTATTGATCCCATCAACCGCATG
GGTCGCACGTTTTACACCGGCATGGCAGGCAAACCCTCGCTGATCGCCATTGAAAAAGCC
CTCGCGACAACCTTTACTGATCAGCCAACTCAACAGGGACAGCGCCACGATGGGGATCTG
GTGGTCAACAACTTGAAGATCGCCCGCGATCACAGGGACATTGTGCACGGTATCTCTTTC
AGCATTCCCCGCGGTTCCCACATCGCGGTGGTAGGTCCCAGTGGCGCTGGTAAATCCTCT
GTGGCTCTAGCGTTGTCCGGACTTTTAGAGTTTGATGGTGCGATTTCCCTCGGCGGCCAC
AACTGTGAGATGTTAGATCTTCGCGCCTCAGTCAGTTCGTGCCCCAATCCCCCACGCTG
TTTAGCGGAAGCATCAAAAGCAATATCGATCTGGCGCGCACGGGTGTTGATTCTGATCAC
ATCCACGCAGCACTTTTAGGCGAAGAACTCCCCGCGGACCTCAAAGTCGGTGAAACCGGC
AAAGGTGTCTCCGGCGGCCAAGCAGCACGCATTTCCATTGCCCGAGGTTTAGTAAAGAAT
GCTGCCGTGATTGTTCTCGACGAGGCGACCGCACAACTCGACTACACCAACGCCCGCCAG
GTTCGACATCTTGCCAAATCCCTTGAGTGCACGTTGGTTGAGATCACCCACCGCCCATCA
GAAGCCCTCGATGCAGACTTCATCATTGTTTTAGAGGATGGCCAATTGACCATGATGGAT
ACACCCAGCAACGTTTCCCAGCACAATGCGTTTTTCCGCACCGCTGTGATGGAGGAAGAA
CAA >RXN02074-downstream
TGATTTCCCGACTTCTCCAATTG Appendix A, page 107

Atty Docket No.: BGI-125CP

>RXN02096-upstream
CGCTTCGACGACCTCACCCACAGCGATATCCGCAGGAATCTCATCGCGGTTTTTGATGAG
CCGTTCTTGTACTCCTCCTCCATACCGCGAGAACATCTCG >RXN02096
ATGGGTTTGGATGTCAGTGATGAGCAGATCGAACACGCAGCCAGGCTTGCCCAGGCTCAT
GATTTTATCGATCGCCTTCCAAACAAATACGAGGAAGTCATTGGCGAACGCGGCCTGACG
CTTTCTGGTGGTCAACGCCAACGCATCGCCCTCGCACGGGCTTTCCTGGCGCATCCCAAA
GTGTTGGTGCTTGATGATGCCACCTCTGCCATTGATGCCTCCACTGAGGACCGCATTTTC
CAGGCCTTGCGCGAAGAACTGCACGATGTCACCATTTTGATCATCGCGCACCGCCACTCC
ACTTTGGAGCTCGGCGATCGGGTTGGTCTGGTCGAAGATGGACGGGTAACAGCACTGGGA
CCGTTGAGTGAGATGCGTGATCACGCTCGTTTCTCGCATCTGATGGCTCTTGATTTCCAG
GATTCTCACGATCCGGAATTCACCCTCGACAACGGTTCACTACCCAGCCAAGAGCAATTG
TGGCCGGAGGTCTCCACAGAAAAGCAGTACAAGATTCTTGCGCCTGCCCCTGGTCGAGGC
CGTGGCATGTCCATGCCAGCAACCCCTGAGCTGCTCGCCCAGATTGAGGCGCTGCCAGCA
GCAACGGAAGAAACACGAGTTGATGCCGGGAGGCTACGCACCAGTACCTCCGGTTTCAAA
TTGCTCAGTTTATTCAAGCAGGTCCGTTGGCTCGTCGTCGCGGTCATCGCGTTGTTGCTG
GTGGGCGTAGCCGCCGATCTAGCATTTCCAACACTGATGCGCGCAGCCATCGACAACGGT
GTGCAAGCACAAAGCACCTCCACGTTGTGGTGGATCGCCATCGCAGGCAGCGTAGTAGTC
CTTCTGTCCTGGGCCGCCGCCGCGATCAACACGATTATCACGGCACGCACCGGTGAACGG
CTGCTTTACGGCTTGCGTCTGCGCTCATTTGTGCATCTATTGCGCCTGTCCATGAGCTAT
TTCGAACGCACCATGTCCGGCCGCATCATGACGCGCATGACCACCGACATCGACAACCTC
TCGTCCTTCCTCCAATCAGGTCTGGCGCAAACAGTTGTCTCTGTGGGCACGCTCATCGGT
GTGGTCACCATGCTCGCCATCACCGACGCACAACTAGCACTCGTTGCGCTGTCCGTGGTG
CCGATCATCATCGTGCTCACTCTCATTTTCCGACGCATCAGCTCCAGGCTGTACACCGCT
TCACGCGAGCAAGCCAGCCAGGTCAACGCGGTATTCCACGAGTCCATCGCCGGTTTACGC
ACCGCGCAGATGCACCGCATGGAAGACCAAGTCTTTGACAATTATGCGGGCGAAGCAGAG
GAATTCCGACGCCTGCGTGTGAAATCCCAGACGGCCATCGCCATCTACTTCCCCGGCCTT
GGCGCGCTCTCTGAAATCGCCCAGGCACTCGTCCTCGGTTTCGGCGCACTGCAAGTAACG
CGCGGCGACATCTCCACCGGCGTACTCGTGGCATTCGTGCTGTACATGGGCCTGATGTTC
GGCCCCATCCAACAACTAAGCCAAATCTTCGACTCCTACCAACAAGCCGCCGTCGGCTTC
CGTCGCATCACCGAACTGCTCGCAACGCAGCCCAGCGTCCAGATCTGGGCACCAACAGGC
ACGCTAGGCAGGCTGCCACGCAGCCTTTATTGCTTGACGACGTCACCTTCGGCTATTCAG
ACGATCCGATCC >RXN02096-downstream
TAGACAACGTCACCGTCCAGATC >RXN02148-upstream
GCCTCAGACTACGGAATCCCTGTGCAGGTGGTATCTGTTGATTCAGCACCGTTTTATGGT
GCGCGTCGCTACTAAGAAATAGTTCGTCAGGAGAATCTTT >RXN02148
GTGTCTGCATCCCGAAAAACTCTCGTTGTGACCAATGATTTTCCTCCACGGATCGGCGGA
ATCCAAAGCTATTTGAGGGATTTCATCGCTACTCAAGATCCTGAGTCGATCGTGGTGTTT
GCGTCGACTCAAAACGCTGAGGAAGCGCATGCCTACGACAAGACTTTGGACTATGAGGTC
ATTAGGTGGCCTCGTTCGGTGATGCTGCCCACCCCAACAACGGCACACGCTATGGCGGAG
ATCATTCGTGAGCGAGAGATCGATAATGTGTGGTTCGGTGCTGCGGCTCCGTTGGCGTTG
ATGGCAGGCACAGCGAAGCAGGCAGGTGCGAGCAAGGTTATTGCCTCCACTCATGGGCAT
GAGGTGGGGTGGTCAATGCTTCCTGGATCGAGACAATCGTTGCGCAAAATCGGCACTGAG
GTGGACGTGCTGACTTATATCTCGCAGTACACGCTGCGCAGATTCAAAAGTGCTTTTGGA
TCGCACCCGACTTTTGAACATTTGCCTTCCGGCGTGGACGTTAAGAGATTCACTCCGGCC
ACGCCAGAGGACAAAAGCGCAACAAGGAAAAAGCTAGGATTCACGGACACCACCCCGGTT
ATTGCCTGTAACTCGCGTTTAGTGCCGAGGAAAGGCCAGGACTCGCTGATCAAGGCGATG
CCACAGGTGATTGCGGCGCGCCCAGATGCGCAGTTGCTCATTGTGGGCAGTGGGCGATAC
GAGTCGACTTTGCGGCGCCTTGCCACTGACGTGAGCCAGAACGTGAAATTCCTTGGGCGC
CTTGAATATCAAGATATGATCAACACGCTTGCCGCCGCAGATATTTTCGCGATGCCAGCG
CGCACCCGCGGTGGCGGACTTGATGTTGAAGGCTTGGGCATTGTCTATCTCGAGGCACAA
GCCTGCGGAGTGCCGGTGATAGCCGGCACCTCTGGCGGCGCGCCAGAGACGGTGACTCCG
GCAACTGGCCTGGTTGTGGAGGGGTCGGACGTCGATAAGCTGTCTGAGCTTTTAATTGAG Attorney Docket No.: BGI-125CP CTTCTCGACGATCCGATCCGCCGCGCCGCGATGGGCGCTGCAGGTAGGGCGCATGTGGAG
GCCGAATGGTCGTGGGAAATCATGGGGGAGCGGTTGACCAATATTTTGCAGAGTGAACCA
CGA >RXN02148-downstream
TGATGGTTGGACAGCTGTTGATA >RXN02168-upstream
AGGGTTTAGTCATCTATTTCGGCTACGCTCACGTAACCTACGCATTCGTAAGTGGTCATG
GGTCCAAGAAGCCCATTCCAAGACTTAGGAGCTTTATTTC >RXN02168
GTGAGTATTTCTTCACTGACACCGCTGCACTCTTTCAAAGAGCCAGCAATTCTGTACGCC
GGTCAGGCTTCTGCCTGGCAGCAGGTGATCGCTGATTCCAGCGAAGACCACATCACCGCA
ACGCACCTGCGCGAGCTCCTGTCTCGCTCCCGTGCAAAGACTGCACCTTTCGCTCGCCAA
ATCACCGCCATCGTGCCTGGCTCACTTGCTCGTCTTGAGGAACTGACCCGCGAAGACGCA
CAAATCGGTGCAGACATCGACGCACAGCCTGCCGTTTCCATTCCAGGCATTCTGCTGGGA
CAGATCGCTGCAACCCGTCAGCTGCGTGACCTCGGACTCGATGTCGCAGCAGCTTCCCGC
CTTGGACACTCCCAGGGCATTTTGGGCGTTGAAGCAGTAGACAATGAAGAAGACGTTTTA
GCTTTCGCCATCCTGCTGGGCGCAGCAGCTTCCCAGTTCGCTGGCAAGGGCGCACATATG
CTCTCTGTTCGCGGCCTGTCCCGTGAGATCATCCAGGACACCATCGCTGGTGTCGATGGG
GTAGAGGTCTCCCTGCGCAACGCTCGTGCACACTTTGTTGTCTCTGGTAAGCCAGAGGCA
CTGAAGAAGGCTGCTGCTGCTCTACAGCGCGCAGCTGATGTTTACAACGAAGACATCAAC
GAAAAGCGCAAGGGTGGATCCCTGGCAGAGCCTAAGTTTGACTACTTGGATGTGGCCATT
CCTTTCCACCACTCCTCCATGCAGGACGGCAGCCGACTTGGCTGTCGAGTGGGCAACCACC
TGTGGCCTAAACGTCAACGCGCGCGCGTTGGCAGAAGCAATTCTAGTTAACCCAGCTGAC
TGGGTTGAGCAGATCGCAAACCTCAAGGCTGATTACGTTCTTTCCCTCGATGCAGGCGTC
AGCCGTTTCACCGCTCCATTGCTAGACGGTCGCGGAATCTCTTTGGTTCCTGCGTTCTCC
GCTGCAGAGCGCGACAACTTGGCTCGCCCTGGCTTCCACGTTCCTACCGCTGAGGATTGG
TCCGAGTTCGCTCCAAAGCTGGTTAAGCTTCCAAACGGTGAGCACAAGGTTCTCACCGGG
TTCTCCCGCCTGACTGGTTATTCCCAATCGTCCTGGCTGGCATGACCCCAACCACCGTT
GATCCTGAGATCGTTGCAGCTGCAGCGAACGCTGGACACTGGGCCGAAATGGCCGGTGGC
GGACAGTACTCTGAAGAAGTCTTCACCAAGAACAAGGAAAAGCTCGTTTCCCTGCTCAAG
GTTGGACGCTCCGCACAGTTCAACTCCATGTTCTTCGACCGCTACATGTGGAACCTGCAG
TTCGGTGCACAGCGCATCGTTTCCAAGGCACGTGCAACCGGTACCTCCATCAACGGTGTT
GTTGTCTCCGCTGGTATCCCAGAGGTTGAGGAAGCAACTGAGCTGATCAACGATCTGAAC
GCTGATGGCTTCCCATACGTTGCATTCAAGCCAGGCACCGTGGATCAGATCCGCGCAACC
CTGAAGATTGCTGATGCAAACCCAGAGACCAAGATCATCATCCAGATCGAGGACGGACAC
GCTGGTGGCCACCACTCCTGGGTCAACTTGGACGATCTGCTCCTGACCACCTACGCAGAG
CTGCGTTCCCGCAAGAACGTTGTCGTCATGATCGGTGGCGGCATCGGAACCCCTGCAAAG
GCTGCTTACTACCTGACCGGTGAATGGTCCACCGATTTGGGCTTCCCAGCAATGCCAGTG
GACGGCATCCTCGTGGGTACCGCTGCCATGGCAACCAAGGAAGCAACCACTTCTCCTCAG
GTCAAGCAGGCACTGGTCGACACCCCAGGTGTTGATCCACACGACGCTGGCGGCTGGGTT
GGCCGTGGCGATGCTCGTGGTGGCGTGACCTCTGGTCTGTCACACCTGCACGCTGACATG
TACGAGCTGGACAACGATTCTGCTGCAGCTTCCCGCCTGATCTCTTCCATCGATTCTGAT
GATTACGCAGATCACCGCGAAGAGCTCATCGAGGCTATCAACAAGACCGCTAAGCCTTTC
TTCGGCGAGGTCGAAGAGATGACTTACGCAGAGTGGATCCAGCGTTGGGTTGAGCTTGCT
TACCCAACTCAGGACCCAACCTGGGATGATCGTTTCCTCGATTTGTTCACCGCATTGAA
GCTCGTCTCAACGAGGCAGAGCACGGCGCCATCACCACACTGTTCCCAGACCATGCGTCT
GTGGAAAATGAGGAAGAGGCCGTCGAAAAGCTTCTTGCTGCTTACCCGCAGGCCCGCGAG
ATCCAGGTCTCTGCGCGCGACGCCGCGTGGTTTATTGGTCTGTGCCGCAAGCACCACAAG
CCTATGCCTTGGGTTCCAGCAATCGATGCTGACCTAGCACGCTGGTGGGCCTTGACACC
CTGTGGCAGTCCCAGAACGAGCGCTACGGCGCGAACTCAGTCCGCGTTATCCCAGGACCA
GTCTCCGTCGCCGGCATCGACCGTGTTGACGAGCCAGTTGCAGAGCTGCTCGGCCGCTTC
GAAGCTGCCTGCGTTGACGCTCTCGACGGCGAGCCAGAAGAGATCTTCGCTCGCCTCAAT
GAGTCCAAGAACGAGCGCGAATTCCTGCTGGCTACCCCACACATCGTGTGGCACGGCAAC
CTGATCGACAACCCAGCTCACGTCCTCAACGAGGGTGCTTTCGAGCTCATCGAGGAGGAT
GGCTACTGGGTCATCCGTATCCTGGCTGATTCCTACTTCGACGATCTGCCAGTTGAGCAG
CGCCCATACCTGGTTCAGCATGTTGACATCCCAGTTGAGCTGGGTGACGCTGGT Appendix A, page 109

Attorney Docket No.: BGI-125CP

>RXN02168-downstream
TGAACCGGTGGTTTCCCAATTGG

>RXN02233-upstream
ATCCCCACCCAATTGGCCCAAGAGCTGCAGAGTTACGTTGTAGAACCCACCTCTGCCTAA
CTGTCGATTTCCCAAGAGCCCCCTTGGGAGTCGATAATTA >RXN02233
GTGCTCGTGACTTCAACATGGGGATGGACCGTCCACGGAGACGGCAAAAAGATCGAACCC
GGCGCAGTTGTCGCTCCTAAAGAGCGCCTGAGCTGGGGGCGCACAATTGGAATCGGTATG
CAGCACGTGATCGCCATGTTCGGCGCCACGCTCCTGGTTCCCACACTCACCGGATTTCCG
GTCAACACCACACTTTTATTCTCTGGTCTGGGAACAATCCTGTTCCTGTTGATCACCAGA
AACCGACTACCCTCGTACCTGGGTAGTTCTTTTGCTTTCATTGCACCTTTAACCGCAACC
CAAGTCCATGGCATTGGCGTGCAGATCGGTGGCATTCTTGTCGCAGGTCTCGTGCTCGTC
GCCATTGGATTTGTGGTGAAAGCAGCGGGCAAACGCGTTATTGATGCTGTCATGCCACCC
GCTGTCACCGGTGCGATCGTGGCACTCATCGGCCTGAACCTGGCACCAACCGCGGCAGGA
AACTTCTCCAGCCAACCACTGGTTGCCACGGCGACCCTCTTTGCCATTTTGATCGCTACC
GTTGCAGGCCGCGGAATGATTGCTCGCCTGGGCATTTTGATCGGTGTGGTGATCGGCTGG
GTTTTCGCAGCTATCACCGGCAACCTCTCAGAAGGCGCAGCAGACACCATCCGTGAAGCA
GCATGGTTCGGACTGCCACAGTTCCACAAGCCGGAATTCCAGCTCTCTGCCATTTTGGTG
ACACTGCCAGTCATCATCGTGCTCATCGCTGAAAACGTCGGCCACGTCAAAGCAGTCTCA
GAGATGACAGGGGAGGACCTCGACGACCTCGCCGGCGACGCACTTATCGCAGACGGATTC
GGCACCACCCTCGCAGGTGCCTTCGGTGGATCCGGCACCACCACCTACGCAGAAAACATC
GGCGTCATGGCGGCCACCCGCGTATATTCCACCGCTGCGTACTGGGTTGCCGCGTGCACT
GCCATCGCCCTTGCCTTCATCCCCAAATTCGGTGCACTGATCTTCACCATCCCCGCCGGC
GTGCTGGGTGGGGCATGTTTGGTTCTTTACGGCCTAATCGGTATGCTCGGCATTCGTATC
TGGCAAGACAACAAGGTCAACTTCAACAATCCAGTGAATCTGACCATGGCTGCCGTTGCT
TTGGTTGCAGGCATTGGTAACCTCACCCTCACCGTTTCGGAGTCACTCTTGAAGGCATC
GCATGGGGCTCTGTAGGCATCATTGTGCTGTACCCAATCATGAAGCGCCTGTACCTTTCC
ATTGGGGAAGGCAAGAACGCAAAGTTC >RXN02233-downstream
TAGTACGCTGCTAAAGTATGCAG >RXN02309-upstream
GTGCCTTCCGTCGACTACGGTTAAACAAAAAGCTTTTTGTCCATTTCACTGGATTCACCG
AAAGAATGAATCCACACTCGATCACCAAAGGTAGCGATGA >RXN02309
ATGAGTAGCGGCCGAACCGTTCCAACCCGTTCCCACGGGCTCGGAAAAGAAGGTGTATCC
ACCACAGGAGCATCTCAGGTCGAGTTTGGTGATCCCGAGCTAACGGCCAGGATCAATGAC
GCCATGGTGCAGGTAGAAGAACTCCTGCACACTGAACTATCGTCCGGGGAAGACTTCCTC
GTCGATATCGTCATGCACCTAACACGAGCCGGCGGCAAACGATTCCGCCCCATGTTTGCA
CTGCTGGCCTCCGAGTTCGGTGAAAAACCACTCTCCGAAACGTCATCAAAGCCGCCGTT
GTCGTAGAGATCACCCACCTGGCCACCCTGTACCACGACGATGTCATGGACGAGGCATCC
ATGCGCCGCGGCGTCCCAAGTGCTAACGCGCGATGGGACAACTCCGTAGCCATCCTCGCA
GGCGACATCCTCCTAGCACATGCATCAGGTCTGATGAGTCAGCTGGGTACCGACACAGTC
GCCCACTTTGCCGAAACATTCGGCGAACTAGTCACCGGCCAAATGCGCGAAACAGTCGGG
CCACGCGACACCGACCCGATCGAGCACTACACCAACGTAATCCGTGAAAAAACTGGTGTC
CTCATCGCCTCCGCAGGCTATTTGGGAGCCATGCACGCAGGCGCCGCACCTGAACACATC
GACGCCCTGAAGAACTTCGGCGCAGCCGTCGGCATGATCTTCCAAATCGTCGACGACATC
ATCGACATCTTCTCGGAAACCCACGAATCCGGAAAAACGCCCGGCACCGACCTCCGCGAA
GGTGTATTCACCCTCCCAGTGCTCTACGCACTCCGTGAAGACACCCCCGTCGGCGCAGAA
CTCCGCGACATCCTCACCGGCCCTCTAGAAGACGACGAGACCGTCAACCACGTCCTCGAG
CTCCTCTCCCAATCCGGCGGACGCCAAGCAGCCCTCGACGAGGTCTACCGCTACATGGAC
ATCGCCAACGCAGAACTCGACCGCCTCCCAGACAGCACCGTCAAGGAAGCCCTCCGCAAC
CTTGCAACCTTCACAGTCAAGCGCGTCGGA >RXN02309-downstream
TAACCCCGTAATCCACCACTTAA Att'y Docket No.: BGI-125CP >RXN02321-upstream
TTTAAAAACTACCCGCACGCAGCACGAACCTGTTCAGTGATGTAAATCACCGCGGAAATA
TTGTGGACGTTACCCCCGCCTACCGCTACGATTTCAAAAC >RXN02321
ATGACCATTTCCTCACCTTTGATTGACGTCGCCAACCTTCCAGACATCAACACCACTGCC
GGCAAGATCGCCGACCTTAAGGCTCGCCGCGCGGAAGCCCATTTCCCCATGGGTGAAAAG
GCAGTAGAGAAGGTCCACGCTGCTGGACGCCTCACTGCCCGTGAGCGCTTGGATTACTTA
CTCGATGAGGGCTCCTTCATCGAGACCGATCAGCTGGCTCGCCACCGCACCACCGCTTTC
TGCCTGGGCGCTAAGCGTCCTGCAACCGACGGTATCGTGACCGGCTGGGGCACCATTGAT
GGACGCGAAGTCTGCATCTTCTCGCAGGACGGCACCGTATTCGGTGGCGCGCTTGGTGAG
GTGTACGGCGAAAAGATGATCAAGATCATGGAGCTGGCAATCGACACCGGCCGCCCATTG
ATCGGTCTTTACGAAGGCGCTGGCGCTCGTATTCAGGACGGCGCTGTCTCCCTGGACTTC
ATTTCCCAGACCTTCTACCAAAACATTCAGGCTTCTGGCGTTATCCCACAGATCTCCGTC
ATCATGGGCGCATGTGCAGGTGGCAACGCTTACGGCCCAGCTCTGACCGACTTCGTGGTC
ATGGTGGACAAGACCTCCAAGATGTTCGTTACCGGCCCAGACGTGATCAAGACCGTCACC
GGCGAGGAAATCACCCAGGAAGAGCTTGGCGGAGCAACCACCCACATGGTGACCGCTGGT
AACTCCCACTACACCGCTGCGACCGATGAGGAAGCACTGGATTGGGTACAGGACCTGGTG
TCCTTCCTCCCATCCAACAATCGCTCCTACGCACCGATGAAGACTTCGACGAGGAAGAA
GGCGGCGTTGAAGAAAACATCACCGCTGACGATCTGAAGCTCGACGAGATCATCCCAGAT
TCCGCGACCGTTCCTTACGACGTCCGCGATGTCATCGAATGCCTCACCGACGATGGCGAA
TACCTGGAAATCCAGGCAGACCGCGCAGAAAACGTTGTTATTGCATTCGGCCGCATCGAA
GGCCAGTCCGTTGGCTTTGTTGCCAACCAGCCAACCCAGTTCGCTGGCTGCCTGGACATC
GACTCCTCTGAGAAGGCAGCTCGCTTCGTCCGCACCTGCGACGCGTTCAACATCCCAATC
GTCATGCTTGTCGACGTCCCCGGCTTCCTCCCAGGCGCAGGCCAGGAGTACGGTGGCATT
CTGCGTCGTGGCGCAAAGCTGCTCTACGCATACGGCGAAGCAACCGTTCCAAAGATCACC
GTCACCATGCGTAAGGCTTACGCGGAGCGTACTGCGTGATGGGTTCCAAGGGCTTGGGC
TCTGACATCAACCTTGCATGGCCAACCGCACAGATCGCCGTCATGGGCGCTGCTGGCGCA
GTTGGATTCATCTACCGCAAGGAGCTCATGGCAGCTGATGCCAAGGGCCTCGATACCGTA
GCTCTGGCTAAGTCCTTCGAGCGCGAGTATGAAGACCACATGCTCAACCCGTACCACGCT
GCAGAACGTGGCCTGATCGACGCCGTGATCCTGCCAAGCGAAACCCGCGGACAGATTTCC
CGCAACCTTCGCCTGCTCAAGCACAAGAACGTCACTCGCCCTGCTCGCAAGCACGGCAAC
ATGCCACTG >RXN02321-downstream
TAAATCGGCGAATCCATAAAGGT >RXN02342-upstream
CAGGTTCGTGCTGCGTGCGGGTAGTTTTTAAAGGTAAAACTTTTTGGGCGTGTCGCCCTT
AAAGCGCGCTTTTCGACGCGACCCCACTACATTGGCTTCC >RXN02342
ATGAACGTTGACATTTCACGATCCAGAGAGCCGCTAAACGTTGAGCTCCTGAAGGAAAAA
TTGCTCCAAAACGGTGACTTTGGCCAGGTCATTTACGAAAAAGTGACAGGCTCCACTAAT
GCTGACTTGCTGGCACTTGCAGGTTCTGGCGCTCCAAACTGGACGGTGAAAACTGTCGAG
TTTCAAGATCATGCGCGTGGGCGACTCGGCCGCCCGTGGTCTGCCCCTGAGGGTTCCCAA
ACAATCGTGTCTGTGCTCGTTCAACTATCTATTGATCAAGTGGACCGGATTGGCACTATT
CCACTCGCGGCGGGACTCGCTGTCATGGATGCGTTGAATGACCTCGGTGTGGAAGGTGCC
GGACTGAAATGGCCCAACGATGTTCAAATCCACGGCAAGAAACTCTGCGGCATCCTGGTG
GAAGCCACCGGCTTTGATTCCACCCCAACAGTTGTCATCGGTTGGGGCACTAATATCAGC
CTGACTAAAGAGGAGCTTCCTGTTCCTCATGCAACTTCCCTCGCATTGGAAGGTGTTGAA
GTCGACAGAACCACATTCCTTATTAATATGCTCACACATCTGCATACTCGACTGGACCAG
TGGCAGGGTCCAAGTGTGGATTGGCTCGATGATTACCGTGCGGTATGTTCCAGTATTGGC
CAAGATGTTCGAGTGCTTCTACCTGGGGATAAAGAACTCTTAGGTGAAGCGATCGGTGTC
GCGACTGGCGGAGAAATTCGTGTTCGCGATGCTTCGGGCACCGTTCACACCCTCAACGCC
GGTGAAATTACGCACCTTCGCCTGCAG >RXN02342-downstream
TAAGGTGACGGTATGGGGAATTC >RXN02348-upstream Appendix A, page 111

Att' / Docket No.: BGI-125CP

```
AAAGACCCGAGCCGAAGCCCTGGCCTGCGCATACTTCCTTGTCAACGCTCGCTGGGATTA
GGTCTTTTCTGAGCGCTAGCATTTCTCCACTCAAAGGAGC

>RXN02348
ATGCTTAACCGCATGAAAAGTGCGCGGCCAAAATCAGTCGCTCCAAAATCCGGACAAGCT
TTACTCACTCTCGGTGCCCTAGGTGTTGTGTTCGGCGACATCGGCACCAGCCCCCTGTAC
TCACTTCACACTGCATTCAGCATGCAGCACAACAAAGTCGAAGTCACTCAGGAAAATGTG
TACGGCATCATCTCCATGGTGTTGTGGACCATCACTTTGATCGTCACCGTCAAATACGTC
ATGCTGGTCACCCGAGCTGACAACCAAGGACAAGGTGGCATCCTGGCGCTCGTTGCTTTG
CTGAAAAACCGTGGGCACTGGGGAAAATTCGTGGCAGTAGCCGGCATGTTGGGCGCCGCA
TTGTTTTATGGCGATGTGGTGATCACCCCGGCGATCTCTGTTCTCAGCGCAACAGAAGGC
TTGACGGTTATCTCCCCAAGCTTTGAGCGCTTCATTCTGCCCGTATCTCTCGCAGTTCTG
ATCGCTATTTTTGCAATCCAACCGCTCGGTACAGAAAAAGTCGGCAAAGCCTTCGGCCCC
ATCATGTTGCTGTGGTTTGTCACCCTTGCAGGATTGGGAATTCCGCAAATCATCGGGCAC
CCAGAAATCTTGCAGAGCTTGTCTCCACATTGGGCCTGCGCTTGATTGTGGCTGAGCCT
TTCCAAGCATTTGTGCTGCTTGGTGCCGTTGTCCTGACAGTAACGGGTGCGGAAGCGCTC
TACGCTGATATGGGCCATTTTGGGGCGAGGCCAATCAGAGTGGCGTGGTTTTGCGCTCGTC
ATGCCTGCTTTAATCTTGACGTATTTGGGGCAGGGCGCCTTGGTGATCAACCAGCCTGAA
GCGGTGCGCAACCCCATGTTTTATCTCGCGCCGGAAGGTCTGCGGATTCCGTTGGTTATT
TTGGCGACCATCGCTACGGTGATCGCATCGCAGGCCGTGATTTCTGGTGCGTATTCATTG
ACCAAGCAGGCCGTGAATTTGAAACTGCTGCCACGCATGGTGATCCGGCATACCTCCCGC
AAAGAGGAAGGCCAGATCTATATGCCACTGGTTAATGGATTGCTGTTTGTATCCGTCGATG
GTTGTGGTGCTGGTATTCCGATCCTCTGAAAGCCTCGCCAGCGCGTACGGACTTGCAGTG
ACCGGAACCTTGGTGCTGGTCAGCGTCCTGTATCTGATCTATGTTCACACCACATGGTGG
AAAACAGCGCTGTTCATTGTGCTCATCGGTATTCCAGAAGTACTTCTATTCGCCTCGAAC
ACCACGAAAATTCACGACGGTGGCTGGCTTCCACTACTTATTGCGGCCGTGCTCATCGTG
GTGATGCGGACCTGGGAGTGGGGAAGTGACCGCGTCAATCAGGAACGCGCAGAGCTGGAA
CTTCCCATGGATAAGTTCTTGGAGAAACTCGATCAGCCACACAATATTGGTCTGCGTAAA
GTTGCCGAAGTGGCAGTATTTCCACATGGCACCAGCGATACTGTCCCGTTGTCATTGGTT
CGCTGCGTGAAAGACCTCAAGCTTTTATACCGAGAGATCGTGATCGTTCGAATCGTCCAA
GAACACGTTCCGCACGTGCCACCAGAGGAACGCGCGGAAATGGAAGTGCTCCATCACGCC
CCGATCAGAGTCGTGCGAGTTGATCTGCACCTTGGTTATTTTGATGAGCAGAACCTGCCT
GAGCATCTCCATGCCATTGACCCAACATGGGATAACGCCACCTACTTCCTGTCGCCCTG
ACTCTTCGGAGCAGGTTGCCTGGAAAGATTGCTGGCTGGCGTGATCGTTTGTATCTTTCG
ATGGAACGTAATCAGGCATCTCGAACTGAGTCTTTCAAATTGCAACCAAGCAAAACCATC
ACGGTTGGAACAGAGCTGCACCTT

>RXN02348-downstream
TAATCAGGCAGTTGCTGGCCAAC

>RXN02372-upstream
GACAATACTGATGGATAAATTTCATATCGAGGACGAAGGGACAACCCCGAACGCCGTGAC
AACATCAACCACAACCCGGGTGAAACATCCGGTAGACCAG >RXN02372
GTGCCACCCGCACCCAAACTTGCAGCCCTAGGGCTCCAACACGTTCTTGCTTTCTACGCA
GGAGCCGTCATTGTTCCGCTGCTGATTGCACAGTCGCTGAACTTGGACACTGCGACCACC
ATTCACCTGATTAACGCTGACTTGTTGACATGTGGCATCGCCACGTTGATTCAGTCTGTG
GGCATTGGTCGCCACATTGGTGTGCGCCTACCGATCGTTCAAGGTGTCACCACTACTGCT
GTTGCTCCCATCATCGCCATTGGTTTGGGCGTTACTGATGGTCAAGGTGGCGTTGCGTCG
CTGCCTGCCATTTACGGTGCAGTCATTGTCTCCGGCATTTTCACGTTCTTTGCAGCGCCG
GTGTTTGCGCGTTTCCTCAAGTTCTTCCCACCAGTTGTCACCGGTACTGTGCTGTTGGTT
ATGGGTGCTTCCCTGCTGTCGGTATCTGCAAATGACTTTGTGAACTACGCCGATGGGGTG
CCTGCTGCCCGCGATCTTGCTTACGGTTTTGGCACCTTGGCGGTGATCATTTTGGCGCAG
CGCTTCTTCCGTGGATTCATGGGCACCTTGGCTGTGTTGATCGGCCTGGTTGGTGGCACC
GCAGTTGCTCTGATCTTGGGCGATGCCAACTTGGATGAGGTGGGAAATGCTGAAGCGTTC
GACATCACCACTCCGTTTTATTTTGGTGTTCCAGAATTTAACGCTGTTGCCATTTTCTCC
ATGATTATCGTCATGATCATCACCATGGTGGAGACCACCGGTGATGTGTTTGCAACGGGG
GAAATCGTCGGCAAGCGAACTCGCCGCAGTGATGTCACCCGCGCACTGCGCGCTGACGGC
CTGTCCACCCTGATGGGTGGCGTCATGAACTCCTTCCCGTACACGTGCTTCGCGCAAAAC
GTTGGCCTGGTGCGCATCACGGGCGTGAAATCTCGCTGGGTTGCGGCAGCTGCTGCCGGC
```

Appendix A, page 112

Att / Docket No.: BGI-125CP

```
TTCATGATCATCCTCGGTGTGCTGCCCAAGGCTGGCGCGATCGTCGCTTCCATCCCTTCC
CCAGTCCTCGGTGGCGCATCCTTGGCACTGTTCGCCAACGTTGCATGGGTGGGCATCCAG
ACCATCGCCAAGTCTGACCTCGCTGATAGCCGCAACTCCGTCATCGTGACCTCCGCACTT
GGCCTAGCCATGCTGGTGTCCTTCCGCCCCGATGTTGCTCAGGCGTTCCCTGAGTGGGCG
CGTATCTTCGTCTCCTCCGGCATGTCCGTCGGCGCGATCACCGCGATCCTGCTTAACCTG
CTGTTCTTCCACGTCGGACGCCAATCCGGTGGACAAGTCGCTACCTCAAAATCCGGTGAG
CGCATCAATTTGGATGCGGTCAACAAGATGGATCGCACCGACTTCGTAGAAACCTTCGCA
CCGCTGTTCAACAGCAAGACCTGGCCTTTTGGAAACCGCATGGGAATCCCAGCCATTCGCC
AACGTCACGGAACTGCGCGAAGCCATCCAAGTCGCTGTGCTCACCGCACCGTTGTCCGAC
CGCGAAGAGCTCATCCACGACTACCCCGACATGGCACAGCTCATTTTGGCCACCGAAGAG
GAAGCCGCCACCATCTCTCAAGACCGTGGTTCGATCGGTCTTGATGATCTCGATGACGTG
GATCAAGAAAAGCTCATCACCGTCACCGAGCAGTACCGCGAACGGTTCAACATGCCGTAT
GTTGCGTACTTCGACACCATGGATTCTGTGGATACCGTCGTAGCCGCCGGCTTGCGCCGC
CTCGACAACTCCGACGAGCAGGAGCACCGCCAAGCGCTATCGGAAATCATTGAGATTGCC
AATGACCGCTTCGATATATTGCTTGCCGACGCTAACCCAGCCCGTTCAGCTTTCGATCGC
AAGTTTACCGAGACTGACTTCCTCGGC

>RXN02372-downstream
TAAAACACCAAAAACAAATTAAG

>RXN02395-upstream
AAACAGGAATATTTAACTCGACTTCTTAAAAAAGCTCTATACGTAAATATCTTGCCCATC
CAGCACCACCTCATTGTGGTGCACAATGGAGAGGACACAC >RXN02395
ATGTCCACCAACTCTGGCAATAACTTGCCTGAATCCCAAGAGTCACCCGAGGAACCTCAT
TATCCTCACGACACCCACCCAGGCCTAGTTCCTGGCATTTCGGTCGATGCTCAACGCAAC
AAGTTCGGACTCGACAAAACCGTTTTCGGCGTCACCGCAGCATTAATTCTGGCGTTCATC
GCCTGGGGCATTTCCAGCCCTGATTCGGTTTCTTCAGTATCGTCCACGATGTTCAGTTGG
GCTATGACGAATACTGGTTGGCTCCTCAACTTTGTCATGCTGATCGGCATTGGCACCATG
CTCTACATCGCTTTTTCGCGCTACGGCCGCATCAAGCTGGGCACGGACGAAGACGAACCA
GAATTCTCTCGCTTTTCCTGGATTGCGATGATGTTCGGCGCCGGCATCGGTGTCGGTATC
TTCTTCTTCGGTCCTTCCGAACCGCTGTGGCATTATCTCAGTCCCCCACCTCACACCGTG
GAAGGATCTACACCTGAGTCCTTGCACCAAGCACTTGCGCAGTCCCACTTCCACTGGGGC
TTATCCGCCTGGGGGCTGTATGCCTTGGTCGGCGGCCGCGTTGGCGTACTCCAGTTACCGA
CGCGGCCGCGTAACCTTGATCAGCTCCACCTTCCGGTCACTTTTCGGTGAGAAAACCGAA
GGTATCGCGGGTCGCCTCATCGACATGATGGCGATCATCGCCACGCTGTTTGGAACGGCT
GCAACCTTGGGCCTTTCAGCAATTCAGGTTGGTCAGGGCGTGCAGATTATTTCTGGCGCT
TCGGAAATCACCAACAACATCTTGATCGCCATCATCGCGATCTTGACCATTGGCTTCATC
ATCTCCTCAGTATCTGGCGTGTCCAAGGGCATTCGTTATCTTTCCAACCTCAATATTTCC
TTGACGCTTGGATTGGTCCTGTTTGTGTTCATCACCGGCCCCACCTTGTTCCTGCTCAAC
TTGATCCCATCGAGTGTGTTGGAATATGGCAGTGAGTTCTTGTCAATGGCTGGCAAGTCT
TTGTCGTGGGGTGAGGAAACCATTGAATTCCAAGCTGGTTGGACGGCGTTCTACTGGGCA
TGGTGGATCGCATGGACTCCATTCGTGGGTATGTTCATCGCGCGTATTTCTCGCGGCCGC
ACCTTGCGTGAATTCGCGCTCATCACCATGGCTATCCCTCCTTCATTTTGATCCTGGCG
TTCACCATTTTCGGTGGAACTGCCATCACGATGAACCGCGAGAACGTAGATGGTTTTGAC
GGCAGTTCATCCAAGGAACAGGTGCTGTTTGATATGTTCAGCAACCTTCCGCTGTACTCG
ATCACACCGTTCATTTTGATCTTTGTGCTGGCAGTATTCTTTGTTACCTCTGCCGATTCC
GCCTCCGTGGTGATGGGAACGATGAGCTCCAAGGTAACCCTGCACCAAACAAATTAATC
GTGGTGTTCTGGGGACTGTGCATGATGGGCATCGCGGTGGTCATGCTGCTTACTGGTGGC
GAATCCGCGCTGACTGGTCTGCAGAACCTCACCATTTTGATCGCCATTCCGTTTGCGCTG
GTGTTGATCGTGATGGCTATTGCCTTTATTAAGGACTTATCCACAGACCCAGCCGCTATT
CGACAACGCTATGCAAAGGCAGCCATCTCTAACGCGGTGGTTCGTGGCTTGGAAGAACAC
GGCGACGACTTCGAGCTCTCCATCGAACCTGCAGAGGAAGGTCGTGGAGCGGGTGCTACC
TTCGATTCCACCGCTGATCACATCACCGACTGGTATCAGCGCACCGACGAAGAAGGCAAT
GATGTTGATTATGACTTCACCACCGGCAAATGGGCCGATGGTTGGACACCGGAATCGACC
GAAGAAGGCGAAGTGGACGCGAAAAAGGAT >RXN02395-downstream
TAAAAAATAACGACTGGCTGGGA
```

Appendix A, page 113

Att       Docket No.: BGI-125CP

>RXN02424-upstream
AGCCAATGCTCAACTGCCCTTCAAAATCGATTTTTGTCGCTTCAAAAAATACACCTTCGA
ACATAGCATCGAACAAGGTGTTTCCGCTAGTCTGAACCAC >RXN02424
ATGACTAACGAGCTCACTCTTCACCATATTTCCGTGTCCCAAATGGACAACAATTGCTAC
CTTTTGGCCGCAAATGGCAACGGTTTACTCATTGATGCTGCAGATGACGCAGCTGCACTA
CTTAAATTAGCCGAAGATGCCGGTGTGACCATCACCAAAGTGTTGACCACCCACCGCCAC
GCAGACCACGTCCGTGCATTGCCGGAGGTTCTCCAGAAGACCGGAGCAACTCACTACGCG
CCTTTCCTTGAGGTGCCAGCTTTGCCCTCCGCTGTTGATGTGGAACTGCATCATGGTGAT
TCAATTGAATTTGAGGGTCATGTATTCCCTATCAGCATTCTGCGCGGCCACACCCCAGGC
GGTGCAGTACTCACCGCTGAGATCGACGGTAAAACTCACCTTTTCGTGGGTGACAGCCTC
TTCCCCGGCGGTTTGGGCAAAACCAGCAGCGAAGGCGACTTCGTCCGACTGTTCAACGAT
GTCAAAGAGCGCATCTTTGACACCTACGACGATGACAGCATCGTGTGGCCAGGTCACGGC
AAGGAAACCACCCTTGGAGCCGAGCGTCCACAGCTGGAAATCTGGTGGGAGCGTCGCTGG >RXN02424-downstream
TAAGCGCTTTTCTCAACCAGGCA >RXN02442-upstream
GCCGTGATGTTGTTGAGCGCGATGTGATTGCCGTATGTGCATGTGAGATTCCGGACGCTG
AGTTCTGCCATTCCTTAATGATAACGGTTATCATTTTCAA >RXN02442
ATGAAGTTTTTTACTGACGCCCTCATAGTGCCTTTTGACGTTTCATTCATCTCCCGCGCC
CTGGTCGCCGGATGCCTGGCCGCAATTTTATGCTCACTCATTGGAACGTGGGTTATTTTG
CGCAGGCTAACCTTTTTCGGCGACGCTATGTCGCACGGCTTGCTCCCCGGAGTAGCCACG
GCATCACTATTGGGCGGAAATCTCATGTTCGGCGCAGCAATCAGCGCATTAATCATGTCA
GCCGGAGTGGTGTGGACCAGCAGAAAATCCAGCCTCTCCCAAGACGTCAGCATTGGCCTG
CAATTTATTACCATGCTTTCCCTCGGCGTGGTTATTGTGTCCCACTCCGATTCCCACGCC
GTAGACCTCACCAGTTTCCTTTTTGGAGACATTCTTGGCGTGCGACCCTCGGATATATTC
ATCATCGCCATTGCAACAGTGTTGGGTGGATTGACTATTTTTCTCTTCCACCGACAGTTC
ACTGCACTCGCTTTCGACGAGCGTAAAGCTCACACCTTAGGACTCAATCCCCGCTTTGCA
CACCTACTCATGCTGGCACTGATCGCATTAGCTACGGTGGTGTCGTTTCAGGTGGTGGGA
ACGCTTTTAGTGTTTGGACTTCTCATTGGTCCGCCCGCCACGGCTGCACTTTTAGTGCAA
GACAAAGCAAGTATTTCACTGATCATGATCGTCGCGTCGCTTCTTGGATGCGCGGAAATT
TACCTCGGGCTTTTAATCAGCTGGCACGCAAGCACTGCCGCGGGAGCCACTATCACTTTG
TTAAGTGCTGCGATATTTTTTGCCACCTTATTGACAAAGAGTGCCATTAGTAGGTTAAAC
TTCACCGCG >RXN02442-downstream
TGATACTGAAAGACATTTTCAAT >RXN02443-upstream
CAAGCACTGCCGCGGGAGCCACTATCACTTTGTTAAGTGCTGCGATATTTTTTGCCACCT
TATTGACAAAGAGTGCCATTAGTAGGTTAAACTTCACCGC >RXN02443
GTGATACTGAAAGACATTTTCAATAATGGGGAGCTCTTTGGGGCTTCCTCCGCGAAAAAT
TTCCGAAAACTACTAGCTGTTCCAGCCGTTGCCGCCTCACTAGCTTTTGGTATCACCGCC
TGTTCCGCTGTAGATGACACCCCTGACATTGTGGTCACCACCAACATCCTGGGTGATGTT
GTAAGCCATATCGTGGGAGATTCCGCAGATGTCCAAGTACTCATGAAACCCAACGCAGAT
CCACATTCCTTCGGAGTCTCAGCACAAGACGCCGCTGCCATGGAACATGCCGATCTCATC
GTGGCCAATGGACTAGGACTTGAAGAGGGCCTTCAATCCAATGTGGACAATGCCAAAAGC
CAAGGGGTTCCCGTCTTGGAAGTCGGCGAACACATCGATGTCATTGACTACTCCCCGGC
GTTCCAGATCCTCACTTTTGGACAGACCCGGCGCGCATGATCGCCGCCACGGAAGTTATA
GAAGCTGAACTGATCAAAGAACTCGATCCTTCCCTGACTGAATCGATCACACAATCAGCC
CAGCACTACCGTGAGGAACTTGTTGCCCTTGATGAGGAAGTCACCGAATTGCTCAGCGGC
GTGGCCCCAGAAAACCGCAAGCTGGTAACCAATCACAATGTTTTTGGATACCTGGCCAGC
CGGTTTAACTACACCGTCATTGACACCATCATCCCAGGTGGAAGCACATTGGCGGCGCCT
TCAGCATCTGACCTCAATGACATCTCCACCGCCATCGAAGACAACAATGTTCCCGCAATC Appendix A, page 114

```
TTCACCGATACCTCAAGCCCACAACGGTTAGCTGAAGTGTTGGCCAGCAACGCTGGCATT
GATGTTCAAGTGGTGTCCATTTTCACGGAATCACTCACCGATGCAGATGGTGAAGCACCC
ACCTACATCAGCATGCAAAAAATCAATGCCGAGCGCATTGCAAGCACTTTGTCC

>RXN02443-downstream
TAAACAGTCCTAAACAGTCTTAA

>RXN02447
ACAGTAGTTCCGGTGTACCTCGCTGAACTCGCACCACTAGAAATCCGCGGCTCCCTGACC
GGCCGAAACGAGCTTGCTATCGTCACCGGCCAGCTGCTTGCCTTCGTGATCAACGCGCTT
ATCGCCGTCACCCTACACGGAGTTATTGATGGAATCTGGCGCATCATGTTCGCCGTCTGT
GCCCTCCCTGCCGTCGCCCTCTTCCTCGGCATGCTGCGGATGCCGGAATCACCACGCTGG
CTGGTCAACCAGGGGCGTTACGACGACGCCCGCCGCGTCATGGAGACCGTCCGTACCCCT
GAGCGTGCGAAAGCCGAAATGGATGAAATCATCGCGGTGCACTCTGAAAACAATGCGGCA
CTTCCTGGTGTTAAGCAGTCTTCGGGCCAGGCTTCAGGCCAGGTTTTCTAGCAAGCACACC
CACATGTCCATCGGCGAAGTCCTCAGCAACAAATGGCTGGTTCGTCTGCTCATCGCCGGC
ATCGGTGTTGCAGTTGCCCAGCAGCTCACCGGCATCAACGCCATCATGTACTACGGAACC
CGCGTCCTCGAGGAATCCGGCATGAGCGCAGAAATGGCTGTGGTTGCCAACATTGCTTTC
GGTGCCGTTGCCGTCATCGGTGGACTGATCGCACTGCGCAACATGGACCGCCTGGATCGC
CGCACCACCTTCATCATCGGCTGTCACTGACCACCACCTTCCACCTTTTGATCGCAGCT
GCCGGCACTCTCCTTCCAGAAGGTAACTCCATTCGACCATTCGCCATCATGATCCTTGTT
GTTGGGTTCGTGCTCTCCATGCAGACTTTCCTCAACGTTGCAGTGTGGGTGTGGCTGGCG
GAAATCTTCCCAGTCCGAATGAAGGGTATCGGCACCGGTATTTCGGTATTCTGCGGTTGG
GGCATCAATGGCGTCCTAGCGTTGTTCTTCCCAGCACTGGTCTCCGGCGTGGGTATCACC
TTCTCCTTCCTTATCTTCGCAGTCGTCGGAGTCATTGCCCTGGCGTTCGTCACCAAGTTT
GTTCCTGAAACCCGTGGCCGCTCACTTGAAGAACTCGATCACGCAGCATTCACCGGCCAG
ATCTTCAAGAAGGCT

>RXN02447-downstream
TAAACCCCCTCCGATCTCTTTGG

>RXN02487-upstream
TCATAGCTACGCGCATGCCCACATTCTAGATCGCCGAAGAAAGCAGCGGGACGTCTCTAT
ATACTAAAGGGCACTAAAGCAACGCAGTTGAAGGGACACC >RXN02487
ATGTCAGCATACGAAACCAAAGAATGGCTCCAGCACTACCCAGAGTGGACGCCACACTCG
CTGGAATATGGCGACACCACCCTGCTGGACGTTTACGACAACAACCTGGCCATTAACGCA
GACAAGCCAGCCACCTACTTTTTCGGTCGTTCACAAACCTACGGTGAACTGGACAAAGAA
GTCCGCAAAACTGCCGCTGGCCTGCGCGCACTAGGTGTCCGCCCCGGCGATCACGTAGCG
ATTATCCTCCCCAACTGCCCACAGCACATCGCAGCTTTCTACGCAGTGCTGAAACTCGGC
GCAGTAGTCATTGAGCACAACCCGCTCTACACCGCCCACGAACTGCTCGAACCCTTCAAA
GACCACGGTGCCCGCGTTGCCATCGTCTGGGACAAAGCCTCCCCACCGTCGAACAGCTA
CGTGGACAGACCCAGTTGGAAACCATCGTGTCGGTCAACATGATCAACGCGATGCCACCA
CTCCAGCGCCTAGCACTTCGGCTCCCAATCCCTGCACTGCGCAAGAGCCGCGAATCCCTC
TCCGGCGCAGCCCCCAACACCGTTCCTTTTGAAACCCTGACCAGCGCAGCAATGGGCGGC
GACGGCGACGACGTAGTTTCAGAACCCACCGTGACCAAAGAATCCGTCGCGCTGATCCTC
TACACCTCCGGCACCACCGGACGCCCCAAGGGTGCCCAGCTCACCCACGGAAACCTGTTC
TTCAATCTTCTTCAAGGAAAGCACTGGGTTCCAGGTCTCGGAGACAAACCAGAACGCATG
CTTGCAGCCCTACCAATGTTCCACGCATACGGTCTGACCATGGTCGGCACACTGTCCGTG
TTCATCGGTGGCGAAATGGTGCTACTTCCCACCCCACGCATCGACCTGATCATGAACGTA
ATGAAAAAGCACACCCCAACCTGGCTACCAGGCGTGCCCACCCTTTACGAAAAAATCGTC
GACGCCTCCGAAAAAGAAGGAATCCCCATCAAGGGAGTCCGCAACGCCTTCTCCGGTGCA
TCCACACTCTCCCAGCGCACCGTTGAACGCTGGGAAAAGCACACCGGCGGACGCCTCGTC
GAAGGCTACGGCCTCACCGAAACCTCCCCCATCATCGTGGGTAACCCCATGAGCGATCAC
CGACGCCAAGGCTACGTAGGAATCCCCTTCCCCGACACCATCGTGCGCATCGCAAACCCA
GAAAACCTCGACGAAACCATGCCCGACGGCAGCGAAGGCGAAGTCCTAGTCAAGGGCCCA
CAGGTGTTCAAGGGTTACCTCAACCAGGAAGAAGCCACCAAGAACAGCTTCCACGGCGAG
TGGTACCGCACCGGCGACGTCGGAGTGATGGAAGAAGACGGGTTCATCCGCCTAGTTGCT
CGCATCAAGGAAGTCATCATCACTGGCGGTTTCAACGTGTACCAGCTGAGGTTGAAGAA
```

Appendix A, page 115

Attorney Docket No.: BGI-125CP

```
GTCCTCGCAGAGCACCCAGACATTGAAGATTCCGCAGTCGTTGGTATCCCGCGTGAAGAC
GGCTCCGAAAACGTCGTTGCTGCCATCACTTTGGTGGAAGGTGCAGCGCTGGATCCGGAT
GGCCTGAAGGAATTCGCCCGCAAGAACCTCACCCGCTACAAGGTTCCGCGCACTTTCTAC
CACTTTGAGGAGATGCCGCGGGATCAGATGGGCAAGATTAGGCGTCGTGAAGTGCAGGCG
GAGTTGTTGAAGAAGCTCGGCAAG

>RXN02487-downstream
TAGACGCCGATTTAAGAGGTCGA

>RXN02512-upstream
GCTGGAAAGTCCCCATTGGCTAAGGAATTTACCAAGGCACCAGCAGGTGCGAAGGCAGAT
TACAGCAACACCAAATAAAAATTAGCCGAGGGAGCATCGC >RXN02512
ATGAAGCCGAAGGATTTCTGCACAGCGGAAAATTGGGCGGAGAATTTAAGCGCACTGGGC
TATCTAGCTGGTTGGCGTTTTGTCCGGATGCTCCCTTTGCCTATTGCTCGCCGGGTGTTT
GACCTTGGGGCGGATCTGGCGTCGAAAAGCGGAAAAGGCATGGGGCAGCTACGCGCTAAT
CTGGCGCGGGTGGTCGGTGCGGAAAACGTTACGCAGGCGCTGGTGAAGCAAGCAACGCGC
AGCTATGCGCGGTATTGGCTGGAAGCGTTCCGGCTACCGGCGATCGCGCGAGATCCTGAG
CTGCTTGCGCGGTTGCGTAAGGGAACTGTTGGCCTAGATTTGTTGGATGAATCTTTGGCT
GCCGGCAAGGGCGTAGTTTTGACGCTCCCACACAGCGGCAACTGGGATATGGCTGGCGCT
TTTCTGATTAGCCATCATGGGCAATTCACCACCGTTGCAGAAAGGGTCAAGCCGGAACGC
TTGTTTGAAGCGTTCGTGGAGTTTCGAGAAAGCCTTGGATTTGAGGTGCTGCCTCTCACC
GGTGGCGAGCGTCCGCCGTTTGAAAAGCTGAAAGAGCGCCTGACATCTGGAGGTATCGTG
TGCCTTCTTGGGGAGCGTGACCTGCGGCATTCCGGCGTGGAGACCACTTTTTTTGGTGAG
AAGACCTCCATGCCAGCAGGACCTGCGCAGCTGGCCATTGAAACAGGTGCGGCGCTGCAC
GTGGTGCATCCATGGTTCGATGACGACGGCTGGGGTCTCAGCGTATCCGATGCCGTGACC
GTGGATAATTTATCCGACACGGTGCAGCGGATCGCACATCTTTTTATGGCAAATATTACG
GCGCACCCCGCTGATTGGCATATGCTCCAACCCCTGTGGTTTGGTGATTTGGATCCGGAG
CGTCTCAAGCGCTCTAGGGAGCAGACAAATGTTCACAAACCGGTGGCATTACAGGAGGAC
AAT >RXN02512-downstream
TAGGTGCGAATTGGAATGGTCTG >RXN02515-upstream
GTGGCTAAGCACAGTTACTTGGCCAAGCTGGGCGGCAGAAAAACCGGCCCAGCTAATACT
TCAGTTTAAAATTCGCTTCAACCCTGAAAGATTGTGACAG >RXN02515
ATGAGCACTCTTGAAATCCGTAACCTGCACGCACAGGTCCTGCCGTCCGATGAGTCCGCT
GAGCCTAAGGAAATCCTCAAGGGCGTCAACCTCACCATCAACTCTGGTGAGATCCACGCC
ATCATGGGCCCTAACGGTTCCGGCAAGTCCACTCTTGCTTACACCCTTGGTGGACACCCA
CGCTACGAGGTAACCGCAGGCGAGGTCCTCCTCGACGGCGAGAACATCCTGGAGATGGAA
GTTGATGAGCGTGCACGCGCTGGTCTCTTCCTGGCCATGCAGTATCCAACTGAAATCCCT
GGCGTTTCCGTTGCTAACTTCCTGCGTTCCGCAGCGACCGCAATCCGCGGCGAGGCTCCT
AAGCTTCGCGAGTGGGTTAAGGAAGTCCGCACCGCTCAGGAAGCTCTGGCAATTGACCCT
GAGTTCTCCAACCGCTCAGTCAACGAAGGTTTCTCCGGTGGCGAGAAGAAGCGCCACGAG
GTTCTGCAGCTTGATCTGCTGAAGCCAAAGTTCGCGATCATGGATGAGACCGACTCCGGC
CTTGACGTGGATGCACTGCGCATTGTTTCCGAGGGCATCAACTCCTACAAGCAGGAGACC
GAAGGTGGCATCTTGATGATCACCCACTACAAGCGCATCCTCAACTACGTTAAGCCTGAC
TTCATTCACGTTTTCGCGAATGGCCAGATTGTGACCACCGGTGGCGCTGAGCTTGCTGAC
AAGCTCGAGGCTGACGGCTACGACCAGTTCATCAAG >RXN02515-downstream
TAACATGTCCGATTTCCTCAATG >RXN02547-upstream
GGGGCCGTCGATAAGCGAAGAACAATTAGCACTGCGCGCGCTGGTCTGACGCATTGGTTA
AGGGGCTGGCGGTCCGGCGCCGGAATCGGCGGAGGAGCTT
```

Appendix A, page 116

>RXN02547
TTGGAGCTCAACAACGCTGCGCGGCTGACCGTGGATGAGTATCCGGCGGCGAGGGAAGCG
CTTGAATCTGCAGGTCAGAGGAATGTAGAGGACCGAACCCGTGCGGTTGATGAGTTCAAA
GCGGCGGATCAAGAGCTGTCTTCTTTGAGTAAAGGCAGCAGTAATATTGAGTACCGTTTG
CTGCAGGTGCGGGAAAATTTGTGTCAGGATTTGGGCGTGAGCCCGCGGGATATGCCCTTT
GCCGGTGAGCTGATTGATCCGAATAATGCGGAATGGGAACCCGTTGTGCAGCGCATTTTG
GGTGGTTTTGCTGCGGAAATGTTGGTTCCTCATGGGTTGTTGCCACGGGTTCGGGATTGG
GTAAATGCCAAACATTTGGCAGCGCTGCTGAAATTCAACGGCGTGGTGACAACGGGGGAG
TACAAAACCTCGCGTTTTCCGGCGGATTCCCTGATCCGAAAAGTTGATGTTGTGGAGTCG
CCGTTTCGCGATTGGGTAAATCAAGAATTAGGCAAGCGTTTTAATATTCGGTGCGTGCGC
ACTCCTGAGGAATTGTCGGCGCTGGGGCCACGCGATCAGGGCGTGACCATTTTGGGTGTG
CGAAAATTTGCGCAGCAGACAGGCGATCCGACGACGCGTTGGGAAAAAGATGATCGCCGA
AAGCTGGGGATCGTTCCACATACCGTTTGGGTTCCACCAATGATGCCAAGGTGGAAACG
CTTCGGGAAACCGTGAAAGCTGGCAAAGCAGTTGTGCAGGCAGCTGATAATCGCATTGCT
GCAAACCGCGCTGAGCTGCGGGAACTTGAACGGCAGTATCAAGCTTCGCAAGAAATTTTG
AAAGTGTCGTGGGCTCAGATTGATGTGGAATCAGCCGACGCGGCGATTGCTGAGCTGGAC
CGATTGCTGGAAGAGCTGAACAACACTCCAGAGGCCACCGAGCTTTCCGCGCGGCATGAG
GCGGCGAAGCAGACGCTCGCGAGGGTTTCTGACTTGCTTGTCGCAGCTCAGAGTGAGGAA
ACCGTGGCGTCGATGAACCTGAAACGCGCCGAAACTGAATTGAAACGGCTCGAAAGCCTG
CCGGTTGCGGAGGTTTCTGAAGAAATCGCGCGGGAAGTGGAGAAACTATTTCTTGCCAAC
ACCCGCCGGGTTCACGCCGCCAACGTGGATGAGCAGACCATTGCGCTGCGCGAGGATCTG
GACAAACAAATCGATGCCAATGAGGCAGAACTTCGACGTTGTGAAAACCAAATTGTTGGC
ATTTTGCGCAGCTATATTGAAACGTGGCCTGCGAACCGCGCTGACTTACAAGCCGAACCT
GAGTTTGTTGGTGAGGCCATCAACCGCTCGGCGAGCTTCGCAGCGATCGTTTGGCAGAA
TTCACGGCCAAATTCCTAGGGCTCATGAACGAGATGTCCACCCGAAACCTCGGCCAAATC
TCGCGGCGTCTACGTGATGCGCGCCGGGAAATCGAGGAGCGCATCGAGCCGATCAACGCC
TCCTTGGCGCAGTCGGAATTCAACGAAGGTCGCTTCCTGCACATCGACATCCGTGATCAA
AGTGGTCCGATTGTGAGGGAATTCCAGCAGAAACTTGATGCCGCTACCAGCGGTGACCTG
GGAACCAGTACCGAGAAACAAGCCTTCGCCCGTTATGCGCTGATCGCTGAAATCATTTCC
AAACTCGCCTCCCACGACTCCGCCGACGCCCGCTGGCGCAACACCGTTCTAGACACCCGC
CGCCACGTTCGCTTCATCGGCCTCGAGCGCGATTCCGACGGCGCAACCGTCAACACCTAC
GTCGACTCCGCATCACTTTCAGGCGGACAAGCCCAGAAGCTGGTGTTTTCTGCCTCGCC
GCTGCCTTGCGCTACCAGCTAGCCGAACCCGGCGCCCATTATCCCACCTACGCCACCGTC
ATTCTGGACGAAGCCTTCGACCGCGCCGACCCCGCCTTCACCCGCCAAACCATGAACGTC
TTCCACAGCTTCGGCTTCCACATGGTGCTCGCGACCCCGCTGAAACTTATCCAAACCCTC
GGCGATTATGTCGGCTCCACCATCGTGGTCAGCTACACCGAAAAACCAAACGCCCAGGGC
GCAATTCAGGGCAATTCCAGTTTCTCTAGGATCGAGAAA

>RXN02547-downstream
TAACATGCCATTGTTTATCGACG

>RXN02566-upstream
GACTCCGGATGATCAAGCAGCGAAACCTTTGTCAAGAACATAGCTCCCCACCCTAGACAA
AAGCCCAAATAAATCTGCTCAATAACCTAACCTAAAGTCC >RXN02566
ATGCACGCCTCGTCGCCCCAACCTCACCCTCAGCGCACCCGTGTTCTCAGCGGCCTGATT
TTCGCCCAAATCATGGTTGGTGCATCCAATGGCGTGACGCTATCGATGGGAAGTTTGCTG
GCAGCACACTTGGCGGGAGCTTCGTGGGGAGGATCAGCCGCCACATTGACCACGATCGGC
GCAGCTATCTTTTCGATTCCCCTTGCCCGCATGGTCTCCACATACGATCGCCGAACTTCA
CTCAGCACGGGCATGTTGCTTGGTTGCGTGGGCGCACTACTGGCGATCCTCGGCGCACAA
TTCGGCTTGTTTCCAGTAGTACTTTTGGCATTTTTGTTCCTCGGATCCATGTCGGCGGTT
AACCTCCAAGCACGTTTCGCCGCAACCGACGTGGCCAGTGAAGAAACCCGCGGCCGCGAC
CTCTCGATCGTTGTGTGGTCCACCACCATCGGCGCAATCGCCGGACCAAATTTATTTGAA
CCAAGCGCCCGATTCAGCGAAACCCTGGGCCTCGAACAACATGCCGGCGCATACCTGCTG
TGTTTATTTGGCCAGCTCATCGCCATCGCAGTCTGGCGATTCACCCTCCCCAAAGGCCTC
AAACCCGAAGCCACCCCAAATGCACCAACAGAAAAGAAGCGCCTCACCCCGAAAGCCCTC
CAAGCCATCACATCGGTTGCAACCGCACACTTCTCCATGGTCGGTCTCATGTCCATGGCC
GCCATCCACATGCAAGGCCACGGCGCCAGCCTCACCATCATCGGCTTCACCATCAGTTTG
CACGTCGCCGGAATGTACGCACTCTCACCAGTGTTCGGCCTGCTCACAGACAAACTCGGC Attorney Docket No.: BGI-125CP

```
CGCAATGTCACCATCTATTCCGGCTTCGCCATGCTCGCCACATCCGCAGCATTTCTTATC
ATTTGGCCCGAACCACAGTGGGCCATGATCACATCCATGATCCTGCTTGGGCTCGGCTGG
AACTCTGCCCTCGTCGGTTCTTCAACATTGCTTGTCGACGCCACCCCCATCCACCACCGC
ACCTACGCCCAGGGGCGCAGCGACCTAACGATGAATCTTGCGGGAGCTTCAGGCGGGTTG
ATCGCCGGACCGTTAATTGCCATGGGCGGAATGCCCTTGTTGGCAGGCGTCGTTCTTGCA
GTTGTGGCGCTTCAAACGGTGCTTAGTTTCAGAACCCGTTCAATTGAAAAGACTCCTGCT
TCATGTTTT

>RXN02566-downstream
TAGCCTAGGAATTCACGCACGAC

>RXN02571-upstream
TGGACAGGCCGGGGCCGCGTACGGTGTTGGTTGAGGTGGTGGAGGGGCGCGTCGAAAAGC
ATTGTCGCTGGTTGTTGCCGCTTTTGGCAGTCGGGATGGC >RXN02571
GTGGTGGCTCTAACTCAAATCGTCGGACCGTCCGGCTCCGGGCTCACGCGGGAATTGGAA
AAACGCTACCGGGAAACGCCCGGAGCGGTGATGCTGACCGCCGACCCGCGCGCGCATATC
ACCTACCTGCGCGCGACAGTCGCCGAGGAGCTGGCCTTTGGGCTGGAACAACGCGGCATC
GTACCCGCGCAGATGTGGGAGCGCGTCCGAAACATCGGGCTCGGCCTCGAGAATCTGCTA
GACCGCGCACCCGCGCAACTTTCCGGCGGGCAAACACGGCGGCTGGCGATCGGCACCGTC
GCCATCTTAGAGGCGCCAACGATGCTTCTCGACGACCCCCTCTCCGGTCTTGATACCTCC
TCGCGAGCCCAACTCATCACAATGTTGGAATCATATGAGGGCGATGTCATCGTCGCTGCG
CACAAGCGGTGGCTCGACGCGCCGACTGTGTACTTAGGGGATTTGGAGGAGCTGTCCCTG
CCTGCGCGGGTGGAATTTTCCGGTCCATCGCGAACGTTTCAGCGATTACAGGAACCCGC
GGACAACAACGCCGACGCTGGTGGCAATTCAACGAATCCCAACCACAGTTTCAGATCGGC
CCCCTGGATATTACTGTTTCTGCAGGTCAAGTGCTGTGGTTGCAGGGTCCCAATGGTTCA
GGGAAGTCCACACTCCTGCGTGGTCTTGCCAATGAACCCGGCACTGAATTGATGCTGCAA
AACCCTAGCGATCAAGTCATTGACTCCACTGTTGCTAATTGGGTGCCAGGCAGTAACAGT
GAAGAACATCCGCTGGATTTATCGCAACGCGAACTCCGCCTTGCCCAATGCGACGCAGCC
CTGGGTAATAACCCGGAAGTTTTGCTTGCTGATGAACCCGACGTCGGCCTTGATGTCGGC
GGTCGAAACGCCATCCACCAGCGCTTTGCGGATTTCTTAGGGAATGGGGGAGCGCTGATC
CTGACCTGCCATGATGAAACCTTCGTGGCAGAGGTAGCTGAATACGCGATAGTGAAGGAA
ATGGGGCTC >RXN02571-downstream
TAGGTTTCTTTGGACCAAACCAC >RXN02581-upstream
ACGGTCACTCGCTCAAGTAGTGTTAGTTTGCAAAAGTAATAAAATGTTCATCTTTGTCGA
TGGTCACAATAGTCATTAAAGAATTGTAAGAGGGGTTCAC >RXN02581
ATGGATTTAGATAAAGCGATTGGTTCATTCTTCGATGAGAATGGAGAAATCAACCTTCCT
CCATTCCTAACTTTGGCAGCCATGGGTGAGTTCATGTACCAGGCTGACATCGCTGAAGGC
GGCGGGGATAAACCACGCATGCATTTCTGGGACTTCTCCGAAGACCGCGATGGCAAGCTG
ATTCAGTACACCCGAAACGAGATCGATACTCGTATCAAGGCTGTAGCAGGCCGTTTGCAG
CAGGTCGCCACCCTGGGTGATCGTGCAGCGATCCTGGCTAACAACAGCCCTGAGTACATT
TTCAGCTTCCTCGGCGCGATCTACGCTGGCATGGTCCCTGTGCCGCTTTATGATCCAAAC
GAGCCAGGACACGCAGACCACCTCAACGCTGTTTTCGCAGACAGCGAGCCAGTTGTCGTT
CTGACCAACTCCAAGTCCGCAGGTGCCGTGCGCAAGCACTTCTCCAGCCTTCCAGCTGCA
GAACGCCCACGCATCCTCTCTGTAGATTCCTTGCCTGATTCTCTCGCGGATTCTTACGAG
AACCCAATGCTGACCGAAGCCGGCCGCCGCCTGGCTGCTCTGCGCCAGTCCGCGCCCATT
GATCTGACCGCATTCCTGCAGTACACCTCCGGCTCCACCCGAACCCAGCTGGCGTTGTT
CTGACCAACCGCTCCATCCTGACCAACGTCTTGCAGATCTTCAGCGCCGCACAGCTGAAA
ACCCCACTGCGCCTGGTTTCATGGCTGCCACTGCACCACGACATGGGCATTATCCTCGCG
GCGTTTGTCACTATGCTTGGCCTGGACAACGAGTTCATGAACCCACGCGATTTCGTGCAG
CAGCCTTCCCGCTGGATTAAGCAGCTCAACCGTCGCGAAAGCGACGTGGACGTTAACGTC
TACACCGTGGTTCCTAACTTCGCCCTCGAGCTTGCAGCACGCTACGCAAAGCCAGCAGAG
GGAGAGACCCTGGATCTTTCCGCATTGGATGCCATCATTATCGGTTCCGAGCCAGTCACA
GAAAACGCTCTGACCACCTTCCGTGAAGCTTTCGAGCCTTACGGCCTGCCTGTTCAGACC
```

Appendix A, page 118

```
CTGCGTCCTTCCTACGGTCTTGCAGAAGCATCCCTGCTGGTCACCACCCCACAGACCGAA
AACCGCCCACTGATCTCCTACTTCGACCGCGAGGCCTTGGCCGAAAACCGCGTTGAGCTT
GTAGAAAAGGGCAATAACAAGGCTGTTGCTTTCGTCTCCAACGGCCAGGTTGCAGCCCCA
CAGCAGCTGGTCATCGTTGATTCCGAAACCGGAACCGAGCTGGCAGACGGCCAGATCGGC
GAAATCTGGACCCACGGCGAAAACACTGCTGCAGGTTACCTCGACCGCGAGGAAGACACC
GCAGAAACCTTCCGCAACCGTCTGACCACCCGCCTGGAAGAAAACTCCCGCGCAGAAGGT
GCTGCCGACGACAACTACTGGATGGCCACCGGTGACCTCGGCGTCATCGTAGACAACGAG
CTCTACATCACCGGTCGTCTGAAGGACCTCATCGTTGTCGCAGGCCGAAACCACTACCCA
CAGGACATCGAGTACACCGTCCAGGCTGCTTCCGCACACATCCGTGCAGATTCCGTCGCA
GCATTCGCAGTCCCAGGCGATGACATTGAAAAGCTCATCATCCTGGCAGAACGCGACACC
ACTGCAAACGAAGCCGACGATGCAGCTGCTGAAGAAGCAATCCGCTCCGCCGTTGGCACT
GCACACGGTGTTGTTCCAGAAGAGATCCGTATCCTCGCACCTGACGAGATCGCGCGTTCC
TCCTCCGGAAAGATCGCACGCCGCGTCAACCAGCGCAACTACATTCAGGAACAAGCTAAC

>RXN02581-downstream
TAGTTCTTTGCAGACACCGCAGG

>RXN02595-upstream
GTGGGTAAAGGGGACTCCGAGGAAGTCCACGTCGTCTTCTTTCGCGGCGCTGAGGATGGT
TTCGCGGATTTGTGCGGGGGAGTGGGTGGGAGAGAAAACG >RXN02595
GTGATCGTTGTGGCCATGGCTTCCATTATGGCTTGTTTAAAAGCAGCTAGACTGAATAAC
CCTATGAAGATCCTTTTGTTGTGCTGGCGTGATACCACTCATCCTCAAGGTGGCGGAAGT
GAACGCTATCTGGAGCGGGTGGGTGAGTTTTTGGCGGATCAGGGCCATGAGGTGGTGTTT
CGTACTGCTGGGCACACGGATGCGCCACGGCGTTCTTTCCGCGATGGTGTGAGGTATTCC
AGGAGCGGTGGGAAGTTTAGTGTGTATCCCAAGGCGTGGGTGGCCATGATGTTGGGTCGT
GTGGGGATTGGCACGTTTTCCAAGGTTGATGTGGTGGTGGATACGCAGAATGGCATTCCG
TTTTTTGGAAAGTTTTTCTCCGGTAAGCCGACTGTGTTGCTCACGCATCATTGCCATAAG
GAGCAGTGGCCGGTGGTGGGTCGGGTGCTGGCGAAGGTTGGTTGGCTGATTGAGAGCCAG
ATCGCGCCGCGCGCTTACAAAACTGCGCCGTATGTGACTGTTTCAGAGCCGAGCGCTGAG
GAGCTCATTGCGTTGGGTGTGGATCAGCAGCGGATTCATATCGTGCGCAATGGCGTGGAT
CCCGTGCCGCTGCACACGCCGAAGCTGGATCGCGATGGCCAGCATGCGGTGACGTTGTCG
CGCCTGGTTCCGCACAAGCAGATTGAGCATGCGATGGATGTCGTCGCGGCGCTCGACGGC
GTGGTGCTGGATGTAGTCGAAAGCGGTTGGTGGCAGAAGGAACTGGTCGATTATGCCCGC
ACGCTGGGTGTGAGCGATCGCGTGGTTTTCCACGGCCAGGTCGCCGAGGATCACAAGCAC
GCCCTGTTGGAGCGCGCCACGATTCATCTCATGCCTTCGCGCAAGGAAGGCTGGGGCCTG
GCGGTCACGGAGGCGGCGCAGCACGGCGTTCCGACGATCGGTTACCGAAGCTCAGGCGGC
CTGCGCGATTCCGTCGTCGACGGCGAAACCGGCCTGCTTGTCGACTCCAAGGCCGAGCTT
ATTTCAGCCACCAAAACCCTGCTTATCGACGCCTCCCTCCGCTCCAAGCTCGGCGCCAGC
GCGAAGCAGCGCGCCGAAAACTACAAGTGGGACACCGCGGGAGCGCAGTTCGAGGAACTA
CTTCTTGGTCTTGCGTCGAAAAAG >RXN02595-downstream
TAGTCCCAGCGGCAACGCCATCC >RXN02613-upstream
AGATATCCCCGGCGATCGCCGCACCCACCCCTCCTTTGCCTCCTACACCGCTCAACTCCT
TGAGTGGCTCGAAATCACCACACCTGCCTAGAAAGAAATC >RXN02613
ATGAAATTTAAGAAAATCGCCCTCGTTCTCGCCTTCGGTCTAGGCCTTGCATCCTGCTCA
TCAGCTTCTGGCGATCCCGCCACCAACGCCGATGGATCCATCGATCTGAGCAAAGTAACC
CTTAACATCGGTGATCAAATCGCCGGAACAGAACAAGTGCTCCAAGCTTCAGGGGAGCTA
GATGATGTCCCTTATAAAATCGAATGGTCATCATTTACCTCTGGACCACCCCAAATCGAA
GCATTAAACGCAGGTCAAATTGATTTCGCGATCACCGGAAACACCCCACCGATCATCGGC
GGCCCCACCAACACCAAAGTGGTCTCCGCCTACAACAACGATGCTTTAGGTGATGTCATC
TTGGTCGCCCCGGATTCTTCAATAACCTCGGTGGCTGACCTTGCTGGAAAGAAAGTGGCT
GTCGCCCGCGGATCCAGCGCCCACGGACACCTCATCCAACAACTAGAAAAAGCAGGCGTG
AGCGTTGACGACGTAGAAATCAACCTCCTCCAACCCTCCGACGCCAAAGCCGCTTTCCAA
AACGGCCAGGTAGATGCGTGGGCAGTGTGGGATCCCTACAGCTCACAGGCGGAACTGGAA
```

Attorney Docket No.: BGI-125CP

```
GGAGCTCAAGTTTTGGTCAGGGGAGCGGGACTGGTCAGTGGGCATGGATTTGGTGTCGCA
AGTGATGAAGCGCTCGATGACCCCGCAAAGGAAGCCGCCTTGGCAGATTTCCTCGATCGC
GTGGCCGACTCTTATGAATGGGCTGAAGACAACACCGATGAATGGGCGACGATTTTCAGC
CAAGAATCCGGCTTTGATCCGGAGGCCTCTCAACTGAACACCCGCAGCCTGCGCCATCAG
GTGCCGCTCGACGAGTCCGTCAACACCTATCAGAACGCGCTTATCGACGCTTTCGTCTCC
GCGGGTCTCGTTGAGGACTTTAATTTCGAGGACACCGTAGACACCCGATTTGAGGGC
```

>RXN02613-downstream
TAAGTATGTCTGAGTATGGCAAA

>RXN02614-upstream
TCATTGTATACGCCACCCTCGGTCTGCTGTCTGAAGCGCTGATCAGAGCTTGGGAACGTC
ACACCTTCCGCTACCGAAACGCATAAGAAAGTTGCTCGCC >RXN02614
```
ATGACTGCCACATTGTCACTCAAACCCGCAGCCACTGTCCGTGGATTGCGCAAATCATAC
GGAACTAAAGAAGTCCTCCAAGGAATCGACCTCACCATCAACTGCGGCGAAGTAACCGCG
CTGATCGGACGCTCAGGTTCAGGAAAATCCACCATCCTGCGCGTGTTGGCGGGCCTATCT
AAAGAGCATTCCGGCTCTGTAGAAATTTCCGGAAACCCGGCCGTTGCCTTCCAAGAGCCT
CGCCTGTTGCCGTGGAAAACGGTGCTCGATAATGTGACCTTTGGCCTCAACCGCACTGAT
ATTTCCTGGTCAGAAGCACAAGAACGCGCCTCGGCACTGCTTGCAGAAGTCAAACTTCCC
GACTCCGACGCCGCCTGGCCCCTCACGCTCTCCGGCGGCCAAGCCCAGCGCGTCTCCCTT
GCGCGAGCGCTCATCTCCGAGCCAGAGCTTTTGCTTCTCGACGAACCCTTCGGCGCCCTC
GATGCTCTGACAAGACTGACAGCCCAAGACCTGCTGCTCAAAACCGTGAACACCCGAAAC
TTGGGAGTTCTGCTGGTCACCCATGATGTTTCCGAGGCCATCGCCCTGGCCGACCACGTC
CTTCTTCTTGACGACGGCGCCATCACACACAGTTTGACTGTAGATATCCCCGGCGATCGC
CGCACCCACCCCTCCTTTGCCTCCTACACCGCTCAACTCCTTGAGTGGCTCGAAATCACC
ACACCTGCC
```

>RXN02614-downstream
TAGAAAGAAATCATGAAATTTAA

>RXN02638-upstream
CTCTGTTGTTGTTCCTGAGGCGCTTCGTCCATTCGTGGGCAAAGACGTGCTCAAGCCAGT
GAAACAAGCCGGTTAATTAAGCGGAAAGCTCGTGGTCGAC >RXN02638
```
ATGGTCAAAAGGTTTGGCTTTTTCGTAGAGGATTCCCTGCCTAAGGTTCCGCTGCATCCC
GAAGAGTCACGGGAGACGTTTTATGGGCGCATCATCATTAGTGCTGTGCGGACGGTGATG
AAAGCCCAGGATGTGCAGATTTCCATCTTCGGTGCGGAGAACATTCCGACCACCGGCGGC
GCACTTTTCGCATCAACCACACTGGTTATTATGACTTCATTCTGGGTGGTATCCCCCGCA
TTCGTGCGGGGTAAGCGCCTGGTTCGATTCATGGCGAAGAAGGAAATTTTCGACACCCCA
GTTGTCGGCACCCTCATGCGCTGGATGAAGCACGTCTCTGTGGACCGCTCCGCAGGTGCC
GGTTCCATGGAAGATGCGCGGAAGCGTCTCGACGCCGGCAGCCTCGTCGGTATCTTCCCT
GAGGCGACGGTGTCACGGTCCTTTGAAATCAAGGAACTAAAAACTGGCGCCGTCCGCATC
GCCGACAGCGCTAACGTTCCGCTGCTGCCACTTATTATTTGGGGCGGCCAGCGCATCATC
ACCAAAGACATCGAGCGCGACTTCGGCCGCTCCCACATCCCCGTATTCATCAGCGTGGGT
GAACCCGTCGACGCCAGCGGCGATCCCGACGAAGCAACGGAACGCCTCTACGAGGCTATG
AAAAAGCTTCTCGACGAAACCCGCACCGCCTACGAACAAAAGTATGGCCCATTCGAAGGT
GGAGAATTGTGGCGCCCGAAATCCCTCGGCGGCGGCGCCCCAACGTTGGAGCAGGCGAAA
ATGTTGGAAATCGCCGAACGGGAACGTCGACAAGCAAAACGCGCGGCAAAGGTCGCCAAG
AAACGCACCACCTTTATAAGGAAAATCTTTAAAAAA
```

>RXN02638-downstream
TGATTGCACTGGGTTCAGCGCCC

>RXN02662-upstream
CCAAGGTGTCACCCTCACCGTTGCCATCGCCTTCATCATCGTCAATATCGCCGTGGACCT
GCTCTACGTCCTGGTCAATCCACGTATTAGGAGCATCTAG

>RXN02662

Appendix A, page 120

```
ATGCGCCGTAAACTAACCACCACATTAGAAAACAAGCCCGGTGCACGACTTGGTGGCTTC
CGCGCACTTGCACCAACTTCAAAAATCGCGCTGGTTTTCCTTCTCCTGATCTTCCTCCTC
GCGATCTTTGCCCCACTGATTGCTAAATACGATCCACTGGCCTCCGGAACTCCAGTCCAG
CCTCCAAGCGGTGAGCACTGGTTTGGTACCGACGCCATCGGCCGCGATATTTTCTCCCGC
GTAGCCACGGCGCCAGAGCCTCCC

>RXN02662-downstream
TGATCATTGGTCTTTTCGCTACG

>RXN02794-upstream
GCGCCCACTCATCGGCGAGCTTCAGGAGATGAGGTTGATGCTCCATTGATAATTTCTTTC
GCTAATAGTCAAATGATCATTTGAGTGTTAGTGTTTTCTC >RXN02794
ATGCTTCTTTCCGCCCGCACACACACGAGTTTCCAAGAACTTGGACTCAATGCTAGTCGG
CGCAAAGCAATCAACTGGACACTGGCACTCACTGTGGTGCTAATTGCCTCCATGTTTGTT
GGCGTGCTCATCGGTGCATCCGGGACCTCAGTGTTTTCCACGTGGACCGTAATTAGCCAC
CATCTTTTTGGCACTGAGCTAGGTGGCTCCGACACTGCCGACGCCATCATTTGGTACATC
CGCACCCCACGCGTCTTGCTCGCTGCCATTGTGGGCGCAGGCCTTGCCCTGGCAGGTGCC
ATCATGCAAGTACTGGTCCGAAACATGCTGGCAGACCCCTATATCCTCGGGGTGAACTCA
GGTGCCAGTTGCGGTGCGGCCGCTGCCTTACTGTTCGGAGTGGGCGCTGGATTTGGCGAT
TACGCCCTCCAAGGCAGCGCGTTTCTCGGCGCAATGGCAGCTTCCGGATTGATCTTCTTC
GTGGCGCGCGCAGCGGGGCGCATCTCCTCGACCCGCTTGTTGATGTCCGGCGTAGCGATC
GGATACATGCTCTCTGCGGCAACAAGCTTTCTCATCTTCTCCTCCGACTCCGCCGAAGGC
AGCCGCTCCGTGTTGTTCTGGCTGCTTGGATCCTTAGGACTTGCCGCATGGAATGGGCCG
ATGGCGATCATCTTCCTCATCGTGGGCATTGCCCTGGCGTTGCTCATGGTGTTGGGTCCG
CAATTGGATGCCTTAAACTCCGGCGATGAAACCGCACTTACCTTGGGAGTATCCCCTGAT
CGCCTCCGCATTCTCCTCCTGGTGATCACCTGCCTGCTGGTGGGATCCATGGTTGCCATG
GCCGGCAGCATCGGATTCATCGGCCTTGTCATCCCCCACCTGGCCAGGCGTTTTGTTAGT
GGAAAACACCGACTCATGCTGCCTGTATCCGCGTTGATGGGCGCAATTTTGCTCATCTGG
GCTGATATCGCCGCCCGCACCCTGCTTGCGCCCCAAGAGATTCCCATCGGCATCATCACC
GCACTCATCGGAGCACCCTTCCTCCTGATTCTGGTTCGCCGGATGCACACCTAC >RXN02794-downstream
TGATTTTTAAGGAATTATGCGTA >RXN02809
AACCTCTCCGTCCCAGCAGCACTAACCAACGCCCTTTCCTACCTCTCCGCAGAGTGGAAC
AACAAGGCTGCAGGCATCGTCTCCTACGGCTCCGCAATGGGCGTTCGCGCAGCTGAGCAC
CTCCGCGGCATCCTTTCCGAGCTTCAGATCGCACACGTTCAAAAGACCGGCCTGCTGAGC
ATCTTCACCGACTTCGAATACCCTAACTTCAAGCCTTCCGAGCAGGGCATCTCCTCTGTG
GACGCTATGCTTGAGCAGCTTGTTGTCTGGACCAAGGCAATGTCCACCATTCGCGAGTCT
GCGAACGTCTATCACTTAAGAACCCCTCACAAAAGTGGCGAGCTCCCCGACTGGGACTCG
CCTCTTTTCGTATTC >RXN02836-upstream
CCATCACTCGGCTTCACCGTCTACGGTGCTGCCCGCAGGACAGAGCGCCCCCAAAAGCTC
GCTTCAGACGGGATCCACCCCCTCGAGATGGACGTCACCG >RXN02836
ATGACAATCGATGAAGGCCGTCGCCAGTTCGAGGTCAATGTATTCGGCGCGATGGCCCTC
ACCCGACTCGTCCTGCCCCACATGCAGAAACAAAAGTGGGGGACGATCGTGAACATCACA
TCGATGGGCGGGAAGATCTACACGCCTCTCGGCGGCTGGTATCACGGCACCAAGTTCGCC
CTCGAGGCCCTCTCGGACGCCCTCCGCCTGGAGGTCGCCCCATTCGGCATCGACGTTGTT
GTCATCGAACCGGGCGGCATCGCCACCGAGTGGGGAGGAATCGCTGCCGACAATCTCGAC
GCAGTGTCGAAAGACAGCGCATACAAGCGCCAGGCTGACGCAGTATCGAAGTCGTTGCGA
TCTGAGGCGAACAGCAACCGCAACTCACCACCGTCGGTTGTCGCCGATGCGATTGGAAAG
GCCGTGACGGCACGTCACCCCAAGACCCGCTATGCCATCGGCTTCGGTGCCAAACCGCTG
ATTGCCTCGCGCAACATCCTCACCGATCGCCAGTTCGACCCAGTGATCACTCGAGCGACT
GGCGTCCCCGCGAC
```

Attorney Docket No.: BGI-125CP

>RXN02836-downstream
TGACCACTCTTCTGCGCCCGTCA

>RXN02922-upstream
CCCACCGCGGCGCAAGCTACCGCCTAGGCGCTCGGAACTCCACCGCCACTATTGATCTCA
GTTCCATATCCGCCCAACTAGTTTCCCAGGGAGCCCACTC >RXN02922
ATGATCTCACCGCAAACAATCATCGACAATCTTGCTCCAGTCCTCGCGGAGATCGCAGCA
ACGGCTGCGCAGCGCGAACAGGATCGAGAATTCAGCCGTGATTTGGCAAAGCAGCTTAGT
GCCGGTGGGTTCACTAAACTCCGCATTCCAGTTGAATTTGGCGGTTTGGGTTTTAGCCTT
CCAGAAGCATTTGAGGTGCTGGTGGCAGCGGCCGCTGCAGATTCAAATATCGCGCAGGGA
TTGCGGCCTCACTTCTTGGCAGTGGAGAGCTTATTGATCGCTCCTTATTCAGAGCACCGC
ACCAAGTGGCTGCGAAAAATCGCTGAGAAAGGCGTGGTCATTGGCAATGCGTTGACTGAA
GTGGGAAACAAGCCAGGTGAGCTGAAAACCAAGATCCGAAAGGAAGGCGAGTCTTACGTT
CTCAGCGACACCAAGTTCTATTCCACGGGCAGTCTTTACGCCGACTGGATTCAAGTACAT
GCGAAAGATGAGGAAGATCAAGATGTTTTCGCCTTTGTTGATCGCGACGCATCAGGCGTT
GTTTTGGTGGATTACTGGGACGAATTTGGGCAACAACTATTTGCCTCCGGAACCAGCTTC
TTTGAAAAAGTCGTGGTAGATCCACTGGACATTGTCACCCGTGATTACACCGCACCCAGC
GCTTTCCAGGCGCTGGCGCAGTCACATCATTTGTCTACGTTGACTGGTATTTCGCAGGCA
ATCACCCGTGACATTGTTACCTATGTACAAAACCGCACCCGTATTTTCAGCCACGGAAGT
GGTGACCTTCCACGCTTTGATCCGCAGGTGCAACAGGTGGTGGGTGAGGTGAAAGCCAAG
TCGTATGCAGTCGAGAAAATCTTTCAGGGTTTCGCACAAGAACTGGATCTTGTCGTCGAT
AAGGCAAAAGCCGGCACTGCTACGGAGGTCGATCTGGCCGCTGTCGACCTGAGCGCCTAC
CAAGCCCAGTTAGCGGTGGCACCTTTGGTGCTGAGCCAGGCCACCCAGGCCTTTGAGGTT
GGCGCAGATGCCTTAAACGGCGGCCACGTGGCTGCCCAATACACGATCGGATCCTTGTCA >RXN02922-downstream
TGAGCCAAGAAATTTTGAGCCAT >RXN02923-upstream
GCATCTACATTGAAGGAATCCACGGAGCGCGCATCGAAGACATCGTTGTGGTGAATGAAG
ACGGTTGTGAAACCCTCAACAACCAGCCCAAGGAACTGCG >RXN02923
TTGAGCATTCTTCTCCTAGGCGGAACCTCTGACATTGCCGGTGAGATTGCCACGTTGACG
TGTCACGGCGAAGACGTTGTTTTGGCTGCTCGTCGACCAGAGGCTGCACAGGGCTTAGCG
GAAGATCTTCGACAGCGCGGTGCCACATCTGTTCATGTTTTGAGCTTTGACGCCCAAGTA
CTAGACACGCACCGAGAACTTGTGAAGAAAACACAAGAGCTAGCTGGCGAGATTTCCCTT
GCCGTGGTTGCTTTTGGCATCTTGGGAGACCAAGAACGCGCAGAAACCGATGAGACCCAT
GCGGTAGAGATCGCCACCGTGGATTACACCGCTCAGGTCTCCATGCTCACTGTGCTTGCT
GATGAGCTCCGCGCACAAACTACTCCAGCAGCGATCGTGGCGTTTTCCTCGATTGCTGGG
TGGCGGGCGCGCCGGCCTAACTATGTCTATGGATCCACCAAGGCTGGTCTCGATGCATTT
TGCCAAGGGCTTGCAGATAGCCTGCATGGGACACACGTGCGATTGATTATTGCGCGTCCT
GGCTTTGTTATTGGTTCTATGACCACGGGGATGAAGCCTGCTCCGATGTCGGTGTATCCA
CGAGATGTTGCCGCAGCTGTTGTTAGTGCTTATACCTCTAAGAAGAGGAGCACGACCTTG
TGGATTCCGGGACGTCTGCGGGTTCTCGCCTGGATTATGCGGATGGTTCCTCGTCCGGTG
TGGCGGAAGATGCCACGC >RXN02923-downstream
TAGATACCCGTTCAGCCCTCACA >RXN02929-upstream
CAGGTGGGGACCTCGCGTATCCCAGCTGGTGGAAGAAATCGCAGCGCAGTTGAATCAGCT
TGCTTCTTCTGAAGCTGTGCCGGCCGCTGCTTAAGTTTTC >RXN02929
GTGCTGAAGAGAATTTTCCTCAACCCCTGGGTGGCTACCGCGTTGTCGGTAGTCATTTTG
GGGTTTGTGGTGCTGTTTTCAGGTTTTAGCGGTGTTATTGATTTAAGCCCCACAGCAGTG
ATTAGACATTTGAGTGGGCAGGACACGCTCACCCCTCGAGATCAGGCCATCTTCTTTGAT
ATCCGGCTGCCTCGAATTATCGCTGGTGTCATTGTCGGAGCAACGCTGGCTATTTCTGGT Attorney Docket No.: BGI-125CP

```
GCTTCTTACCAAGCGGTATTTAGAAACCCGCTGGCTGATCCTTATTTGTTGGGTGTGTCC
GCAGGTTCTGGCCTTGGTGTCACGGCAGTGATTGTTGGCGGTACCGTGCTGGGATTTTCT
GCACCGAGCATCGGCGTGATTGGTGCAGCATTTGTAGGTGGTGTTGCCGCAGTACTTGCC
ACGCTGATGGTGAGTCGGGGAGTAGGACAGGGATCATCAACCACCGTGGTTATTTTGGCG
GGCGTGGCGGTTGCTGCTTTTGCCAGTTCCATCCAGACCTATATTCAGCAACGACACATC
GATACGGTGGCGCGCGTATATGTGTGGATGTTGGGCAACCTCAATGTCACCAACTGGATG
TCGATCTTCATCGTGGCTGTGGTGGCGGGACTATGCGCGGCCGTGATCATGTCCTGCGCC
AGGTTGTTAGACGTGATGGCTGTTGGTGATGTGGAAGCCCGCACATTGGGCGTCGATCCA
GGCCTCGTACGCATTGGCATTGTCATCGTGGCAACCCTTGGTACAGCTGCAGTGGTATCC
ATTTCCGGTCTCATCGGGTTTGTGGGCATCATTGTTCCGCACGCCCTGCGCCTAATTGTT
GGCCCGGGGCATCGGATTTTACTGCCACTGTCTTTCGTATGGGGTGCCATTTTCCTCGTG
TTGGCAGATACCGCAGGGCGAACATTGATGGCTCCTCAGGAACTTCCCGTGGGTGTGGTG
ACAGCTGCACTCGGCGCACCGTTCTTCTTATTTATTTTGCGCAGAACCAGCAGACAACGA
GTTCCAAAAAGGAGTGCT

>RXN02929-downstream
TAAGTGGCGATCATTGAATGCGA

>RXN02933-upstream
TGATCTGCTGTATCAGGTGGTTGATCCAAGAGTCGGTGCTGTTGGGGTTGCTAGCACTAA
GGTTCCAGGGAGCGTGGCTTAAGTGACAACGATCAAAAAC >RXN02933
ATGCCCCTTTCAGGGAAAATCGGCGGCTTCATCGTTGCCGTTGTATTTGTTCTTGCTGCG
CTGTCTTTCATTTGGACTCCGTTTGATCCAGTTCAAGCTTTCCCACAGGAGCGCCTTGAG
GGAAGTTCTTTGAGGCACCTGTTGGGAACGGATCGTTATGGTCGCGATGTTTATCCCAG
ATCATGGTTGGTTCCCGCGTCACGTTGTTGGTGGGCATCATTGCGGTGGCGATCGCAGCA
TTAATCGGCACGCCACTGGGTATTGCTGCGGGAATGCGCCGTGGCATGGTGGAAACCTTT
GTCATGCGTGGTGCCGATTTAATGTTGGCGTTCCCAGCACTGTTGTTGGCGATTATTCC
GGCGCCGTTTTCGGCGCCTCCACGTGGTCCGCGATGGTCGCGATCGGCATCGCAGGCATC
CCTAGTTTTGCCCGCGTGGCTCGTGCAGGCACATTGCAGGTGACCAGTCAGGATTTCATC
GCAGCTGCTCGGCTATCAAAAGTAAGTTCCGCCCGGATCGCGCTTCGCCATATTTTGCCC
AACATCACCAGCATGTTGATCGTTCAGGCATCAGTAGCTTTTGCCCTGGCGATCCTGGCG
GAAGCCGCATTGAGTTTCCTCGGTTTGGGCACCACTCCCCCGGATCCCAGCTGGGGTCGC
ATGTTGCAAACCGCTCAAGCATCCATCGGCGTCACCCCCATGTTGGCGGTGTGGCCCGGT
GCTGCGATCGCTTTGACGGTCCTTGGTTTTAATCTTTTCGGTGATGGTTTACGCGATGCC
ATCGATCCAAAGCGGGAGGTCGGCCGTGCT >RXN02933-downstream
TAAAGTTTCTGATTTAACGGTTG >RXN02947-upstream
GTATGTTCACACAAGAACCCTGCACAACGCCTTCAAAGTACGTCGACCACGACCAAGCGC
ATTATTCACTCTCACCCTTCAGGATTTAGACTAAGAAACC >RXN02947
ATGACTGCAGCACAGACCAAACCTGACCTCACCACCACGGCTGGAAAGCTGTCCGATCTT
CGCTCCCGTCTTGCAGAAGCTCAAGCTCCAATGGGCGAAGCAACTGTAGAAAAAGTGCAC
GCTGCTGGCAGGAAGACTGCCCGCGAACGTATCGAGTATTTGCTCGATGAGGGCTCTTTC
GTAGAGATCGATGCTCTTGCTCGTCACCGTTCCAAGAACTTCGGCCTGGATGCCAAGCGT
CCAGTTACTGACGGTGTTGTGACTGGTTACGGCACCATCGATGGCCGTAAGGTCTGTGTG
TTCTCCCAGGACGGCGCTGTATTCGGTGGCGCTTTGGGTGAAGTTTATGGTGAAAAGATC
GTTAAGGTTATGGATCTTGCGATCAAGACCGGTGTGCCTTTGATCGGAATCAATGAGGGT
GCTGGTGCGCGTATCCAGGAAGGTGTTGTGTCTCGGGTCTGTACTCACAGATCTTCTAC
CGCAACACCCAGGCGTCTGGCGTTATCCCACAGATCTCTTTGATCATGGGTGCCTGCGCT
GGTGGTCACGTGTACTCCCCTGCTCTGACTGACTTCATCGTCATGGTGGATCAGACTTCC
AAGATGTTTATCACCGGCCCTGATGTCATCAAGACTGTCACCGGTGAAGATGTCACCCAG
GAGGAGCTCGGTGGCGCTCACACCCACATGGCTACCTCCGGTACCTCCCATTACTCGCT
TCTGATGATTCAGATGCTTTGGATTGGGTTCGCGAGCTGACCTCTTATCTTCCATCCAAC
AACCGTGCGGAAACTCCTCGCCAGGAGGCCGACATCATGATCGGTTCCATCCAGGAAAAC
ATCAACGATGTGGATCTGGAATTGGACACCATCATCCCGGATTCCCCGAACCAGCCTTAT
```

Appendix A, page 123

Attorney Docket No.: BGI-125CP

```
GACATGAAGGAAGTTATTTCCCGCATCGTCGACGACGCCGAGTTCTTCGAGATCCAGGAA
GACTACGCAGAGAACATCCTGTGTGGCTTCGCTCGCGTTGAGGTCCGTTCTGTTGGCATC
GTGGCTAACCAGCCAACCCAGTTCGCTGGCTGCTTGGATATTAAGGCATCTGAGAAGGCT
GCCCGTTTCATCCGCACCTGCGATGCCTTCAACATCCCAATCCTTGAGTTCGTGGACGTT
CCAGGCTTCCTGCCTGGCACCAACCAGGAATTCGACGGCATCATCCGCCGCGGCGCAAAG
CTGCTTTACGCTTACGCTGAAGCAACCGTCGGCAAGATCACCGTCATCACCCGCAAGTCC
TACGGCGGAGCGTACTGCGTGATGGGTTCCAAGGATATGGGCGCTGGCCTGGTA

>RXN02955-upstream
ATGCACTGGCTCCCATCAAAGACGAATTCTTGACCTCAGAATTCCAGCGTGAACTCTACG
AAGCAGTGCGCGCCGCTGATACTTCAGGAGGTGCGGCATC >RXN02955
ATGATGAATTTTAAGTCCATCGTGTGCGTCACTGCCTGGCAGGTGTTTAGCCGCCAGGTG
CTGCACAGCCCATCAACGTGGTCTGAAGAACTATCCAAGCTGTTGTTCGTGTGGCTATCT
TTCGCAGGTAGTGCGTTCCTCTTTGGAGAGCGTGGACATATTGCGGTTGATTTCATCGCG
CGCAAACTGCCTGTTTCTGCGCAGCGGGTCCTGCAGGTCATTGTTCAGTTGTTGATTGTT
GTTTTTGCGATCCTCGGCATGATCTGGGGTGGCTACTTGGCTGCATCAATCGCGTGGAAT
CAGCAGCTCACTGCGCTGCCACTTACCTTGGGATGGGTGTATGTTGTCATCCCGATCGCG
GGTGTGTTCATCGCGTTGTTCGCGATCATCGATCTCATCGAAGTGGCCACAGGCAAGGAA
GAGCCTTACCCCCTTGTTGATGAATCAGAAGAACCTCGAGATTTGGACGAGCTAGAGGCC
CAAAGCGCTATAGATTCTGCAAGTTCAGCGGAAGGTAGGAAC >RXN02955-downstream
TAATATGTTGTCGCCAGCAGCTG >RXN02966-upstream
AAATATACCCCCCAGGGTATCTTGACAGATTAAAGCTCGATGTTTTAGGCTCTACATATA
CCCCCACGGGTATCCCCTCAACTTTGATCTAAGGTGTCAC >RXN02966
ATGCTTTTTGAACGCATCTACGAAGAAGGCCTCGCCCAAGCCAGCTATTTCATTGGCTGC
CAACGCGAAGGCAAAGCGATTGTTGTTGATGCTCGCCGAGATATCCAGACCTATCTGGAC
CTTGCAGCAAAAAACAACATGGTCATTAGCGCCGTAACCGAAACCCATATTCATGCCGAT
TATCTCTCCGGTACTCGCGAACTTGCAGCTGCCACCGGCGCCGAGATTTTCCTCTCTGGC
GAAGGCGGAGCTGATTGGCAATATGGCTTTACAGGCACCACCTTGATGCACAATTCCACC
ATCAAGCTGGGAAATATCACCATCACAGCCAAGCACACTCCCGGACACACTCCAGAGCAC
CTGTCATTTTTGATTACTGATGGTGCGGTCTCAAAGGATCCCGGTTTTATGCTCAGCGGT
GACTTCGTCTTCGTAGGTGACGTGGGACGTCCAGATTTACTTGATGAGGCAGCTGGCCGC
GTGGACACCCGCTTCGCCGGAGCACAGCAACTCTTCCATAGCCTAAAAGAGCAGTTCCTT
GCACTCCCCGACCACATTCAGGTTTATCCAGGTCATGGTGCTGGCAGCCCTTGTGGCAAG
GCATTGGGCGCGATCCCTAGCACCACCGTGGGATATGAAAAGGCTAATGCGTGGTGGGCT
CCATATCTGCGCAGTGATGATGAAGCCGGCTTTGTGGAAGAGCTTCTCGACGGCCAGCCA
GATGCCCACGCTTACTTTGCTCGCATGAAAAAGCAGAACAAGCAGGGACCTGCAGTACTT
AGTACATTATCCCCGCTTGTGAAGCTAGAAGCCGAGGAAGTCGTCGAAAAGCTTGGTTCT
GAAGCAGTATTTGTGGATACCCGCGAGCAAACCAAGTCCATCTCGGAACCGTTGTTGGG
GCATTGAATATTCCGCGCGGCGCCAAGGCGTCCAATTTTGCGGCGTGGGTTATTGATCCT
CAAAAGGATGCTCAGGACCTTATTGTTTTGGCTCCGGACGCCAATACCGCTGCCGATTTC
CGCGACGCTTTGCTGCGGGTTGGCATCGACACTGTGCGTTATTTCACCAACAGTATCGAT
GGATTGCCTACCTTTGTGCCAGAACTCATCTCCCCCGCTGAGCTAGCTGAGACCAACTAT
GACGCACTGATTGATATCCGTGCAAAGTCCGAATTTGCCGCTGGCAGCATTCCCGGCGCG
CAGCAGCTTTCTGGAGGTTCGGCCATGTGGCGCCTCAATGAGCTGCCTGCGGGTGGCACT
TTGGTAACCTTCTGCCAATCAGGAGCGCGAAATACCGTGGTAGCCAATGCTTTGCGACGC
GCCGGATTCACCGTTATCGAGCTCGAGGGCAGCTACGCCGCGTGGGAAAAATCAGCTGCC
AATCCTAAAAACTTGCAGACTGCCGTC >RXN02966-downstream
TAGTTTTAGATCCGGCGCTGTAT >RXN02979-upstream
```

Appendix A, page 124

CTAGGTCAAGGAACTTCACTCGGCTAGTCCTTAGACTCAAATGTGTTCAGACAAACACTG
GCACCGTAAGGCACGAAAGTTACCGAAAGGACTGGTTCCC

>RXN02979
ATGACCGCCCCAAACACTCTCAAGCAAACAACTCTTCGCTCTGATGAGTTCTCTTGCCCA
TCCTGTGTCTCCAAGATTGAAAACAAATTGAATGGATTGGATGGCGTCGACAATGCAGAG
GTGAAGTTCTCCTCCGGAAGAATCCTTGTTGATCACGACCCCAGCAAGGTCTCTATCAAG
GATCTAGTCGCTGCAGTCGCAGAGGTTGGCTACACCGCAAAGCCATCAGCAATC

>RXN02979-downstream
TAAAACTCTCAGTTAGACCATTA

>RXN02987-upstream
GTTGTTTGATCCAGGTCAAGGAATTAACCCGGAAAGGACCGTATCTTTAAAGGTGCAAGC
ACAGGAACATGACGATAAAAGATGAAAGGACCTGGTTACG >RXN02987
ATGACCGCCCCGCCACGCTGAAGAACACCACCTTGCGCTCTGATGAGTTCACCTGTCCG
AGCTGTGTCGCCAAGATCGAAAACAAGCTGAATGGTTTGGACGGCGTGGAGAATGCGGAG
GTGAAGTTCTCCTCCGGACGCATCCTGATCACCCACGACCCACAGAAGGTCTCCGTACGT
GACCTGGTCACCGCGGTAGCCGAGGTCGGTTACACCGCCAAGCCGTCGGCGATC >RXN02987-downstream
TGACGCACTCCCGACCCCACAAG >RXN02991-upstream
TTGTCGTGTTCGCGATCTTCGCCGTTGGCTTCATGATTCTGACCCTGCCTATGGGCCTTG
GCTTGGGCAAACTCTCTGAGCGTTTGGCGGTGAAGAAGTA >RXN02991
ATGGCTAATACAGTTCGCGCAACAGTCCTCTACGATGCTCCTGGACCAAAGGGCCGTCGA
TTCAACCTCATAATCACCATTCTCACGGTGGTTCTGGGATTGGCGCTCCTCTTCTGGATT
GGCTCCATGCTTTCAGGCAACGGCCAACTCGATGCCAACAAATGGACTCCGTTCATCAAT
TCCCAAACCTGGACCACCTACATTCTTCCTGGTTTGTGGGGCACGCTGAAATCTGCCGTG
TTCTCGGTGATCTTGGCTCTGGTCATGGGTACCGCACTGGGTCTTGGCCGTATCTCTGAA
ATCAGGATTCTCCGCTGGTTCTGCGCCGTCATCATCGAGACTTTCCGAGCCATTCCGGTT
CTGATCCTCATGATTTTCGCCTACCAGATGTTCGCCCAGTACAACATCGTGCCGTCGAGC
CAGCTCGCGTTCGCCGCCGTGGTATTCGGTCTGACCATGTACAACGGTTCTGTGATCGCA
GAGATTCTGCGTTCTGGTATCGCTTCCCTGCCTAAGGGGCAGAAGGAAGCAGCGATTGCG
TTGGGTATGTCTTCTAGGCAAACCACCTGGTCAATCTTGTTGCCTCAGGCCGTGGCTGCA
ATGCTCCCAGCGTTG >RXN02992
ATCGTCCCTTTGGGCAACACACTGATCGCACTGACTAAGAACACCACCATCGCCTCTGTC
ATTGGAGTTGGCGAAGCCTCCCTGCTGATGAAAGCCACCATCGAAAATCACGCCAACATG
CTATTTGTCGTGTTCGCGATCTTCGCCGTTGGCTTCATGATTCTGACCCTGCCTATGGGC
CTTGGCTTGGGCAAACTCTCTGAGCGTTTGGCGGTGAAGAAG >RXN02992-downstream
TAATGGCTAATACAGTTCGCGCA >RXN02993
GTTGCTGAATACGTAGTCAACTCCATCGCTGATGACAAGGGCTGGGATCACCCCACCATC
GAATGGCGTGAATCCCTTCTGCGCAGCGTGAAACCCTCATTCAAAACGGTGAGGTAGAC
ATGATCGCAGCAACCTACTCCATCAACGCTGGCCGTTCAGAGTCCGTCAACTTCGGTGGC
CCATACCTGCTTACCCACCAGGCTCTGCTTGTTCGCCAAGATGACGATCGCATTGAAACC
CTCGAGGACTTGGATAACGGTTTGATCCTGTGCTCCGTTTCCGGATCCACTCCAGCTCAG
AAGGTCAAGGATGTCCTCCCAGGCGTTCAGCTCCAAGAATACGACACCTACTCTTCCTGT
GTTGAGGCACTGTCCCAGGGCAACGTTGACGCCCTGACCACTGACGCCACCATCCTCTTC Attorney Docket No.: BGI-125CP

```
GGCTACTCCCAGCAGTACGAAGGCGACTTCCGCGTTGTGGAAATGGAAAAGGACGGCGAG
CCATTCACCGACGAGTACTACGGCATTGGCCTGAAGAAGGATGACCAGGAAGGCACCGAC
GCTATCAACGCCGCACTTGAGCGCATGTACGCTGACGGCACCTTCCAGCGACTGCTCACC
GAGAACCTCGGTGAAGACTCCGTGGTTGTTGAAGAAGGCACCCCAGGTGACCTCTCCTTC
CTCGACGCAAGC

>RXN02993-downstream
TAGTGTGACGGCTTTTAAAAGCC

>RXN02996-upstream
TCCTGCCACAGAATCTGCCTGCTGCTCCATTAACTAAAAATTGCAGGCTAGAATAGAGGG
TCGATTAGGAGTCGATGAAAAAGTCGGCGCCAACGAGGAG >RXN02996
ATGAACAACAACGTGAGTGATCAAAAGCTAAGTGGTAAAGAGCTTGCGGCACTAGAGAAA
CAAGCCGCAAAAACTCTCGAACTTGGTGATAAGAAGTGGTATCTCATCGCGGGAGTCGTG
CTTTTCGCCATCGCACTCGTCCTCCCACATATCCGTGGAGTGATGGGCTGGCAGGTTCTG
ACGCTGTCGAATGTCGCGGAGGATGCCGGCATTACCCTTGGTGAGTACGGTTTCTACTGG
TTGGGCACCATCGGTGTATTCCTGCTTTCTTTGGGCACTGTCGTGTTTAAGCGCACGTGG
ATGGCGTGGATTTCATGGATTTTCTCCTGCGTCACTCTTGTGTTCGCTGTGTTTGCCATC
TGGATGCGCCAAACAACCACCAGCACCCAAGTGAATTTCGTCAACATTGGCATGATGCTT
GCTGTGATTGCAGCGATCCTTGCTGTGTGGGGTCTATCTTCGGTGATTTTGGCCCGCAGT
GATCGCCAAATGGAGATCGCTGAAATGCGCGCCGAGAACCCAGACCTTGATGGTGTTGCA
GCTACCCAGCGCGCACTTCTTGAGCAGCAGCAAAGCAACCCAGAAGATAATCCTTTGCTT
GTCGACGATCGTCGCGCCCGCATCGCCCGCCGCCGCGAGCGTGAACAGGATGCACAAGGG
GAGCAGGCT >RXN02996-downstream
TAAGTTCTAGTTCAAGCGGTTGA >RXN03060-upstream
TATGTCCTTTGGCTCCGGTACCCTGGCAGGAGTACCTGGGCTGTTTTTCTAAAATGGCCT
GACGTTTTCAAGATTGAATTTAAGGAAAGCATCGTAGTTC >RXN03060
ATGAGTAACCCTGCCGCGAGCACACCTGCCAACAATTCGGACGATGTTGCGAAGGAGAAT
TGGGACTCTTCTTTTACGCCGAAGACTGACATTGACTCTTCCCAGCCTGTCAATAACTCG
ACTGGTGAAGCCGCTGCGCGCGCAGTGAACCTGTACAAGGCGTATGGCCAGGGTGATACC
ACTGTCACCGCGTTGGATCACGTCAACGTGGAGTTTGAGAAGAACAAGTTCACTGCCATC
ATGGGTCCTTCTGGCTCGGGTAAGTCCACGTTGATGCACTGCATGGCTGGTCTGGATGCT
GCGACTGGTGGTTCGGCATTCATTGGTGATACGGATCTGTCGCGGTTGAAGGACAAAGAG
ATGACCTCTTTGCGTCGTGATCGTTTGGGATTCATTTTCCAGTCGTTCAACTTGGTTCCT
ACTCTGACGGCGTCGGAGAACATTACGCTGCCTACCGATATCGCGGGCCGCAAGATTGAT
CAGTCGTGGTTCGATGAGATTACCTCTCGTCTGGGTCTGACTGAGCGCCTTAAGCACCGT
CCTGCAGAGCTCTCTGGTGGTCAGCAGCAGCGTGTGGCGTGTGCTCGTGCGTTGGTGTCT
CGTCCGGAGATCATTTTCGGCGACGAGCCAACCGGTAACTTGGATTCGAACTCTTCTAGG
GAAGTGCTGGATATCCTGCGCACCGCAGTTGATCAGGATGATCAGACCGTTGTGATCGTT
ACCCACGATGCCAAGGCGGCGTCCTATGCAGATCGTGTCATTTTCTTGGCGGACGGTCGT
ATCGTGAACCAGTTGTTTGATCCCACCATCGAGGAAATCTTGGCCACGATGAACGGAATT
GAGGATATTGCC >RXN03060-downstream
TAATGAATTCCGGTTCCACAATG >RXN03065-upstream
GACGGCGCCAACTCTGCATTCTTCGCCTCAGCGTGCGTGGCAGTGTTTGCACTGATCGTG
GGCTTCTTTGTAAAGAGGCCAGCCCGCTAAGCTAGGTCGC >RXN03065
ATGATCAGCATTGGAACCGACCTCGTTCACATTTCGGCGTTCGCAGAGCAGCTTGCACAG
CCGGGAAGTTCCTTCATGGAGGTGTTTTCCGCAGGGGAGCGTCGTAAAGCAAATGAACGC
```

Appendix A, page 126

Attorney Docket No.: BGI-125CP

```
CAGGCAAGCCGCTACGCCGAGCATTTGGCGGGGCGGTGGGCGGCAAAAGAATCCTTTATT
AAGGCCTGGTCACAGGCCATTTATGGCCAGCCACCCGTGATCGCCGAAGAAGCCGTGGTG
TGGCGGGACATCGAAGTTCGCGCAGACGCGTGGGGGCGCGTCGCGATCGAATTGGCGCCC
GAATTGGCCGCAGTGGTCCGGGAATCCATCGGGGAGTTTTCCAGCAGCTTGAGCATCAGC
CACGACGGCGACTACGCGGTGGAACGTGCGTGT
```

>RXN03065-downstream
```
TGACTATCCAGTAGCCACGGAGA
```

>RXN03079-upstream
```
GAGCGGGGTTGCTATCGGCCGAAAGTTTAGGGTTTTGTTCAATCTGTTGGTTAGTATTGC
TTGGGTAAACAAGTCATAACAATTTTCATTAAGGGTCGTT
```

>RXN03079
```
TTGTCGCGCACAGGTGTTTCGAAAAAACCAAAGCTCACCGCTCCTGTTGTCATCATCGGC
ACCCTCGTCTTGTTGATCATCGCCTTCACCGCTTCCCTCATGCTGGGTCCCGTGACGGTT
CCATTGAATGAGCTTGCAACCAACCCCGTTGTCACCGATATCCGTGCACCACGCATTATC
ATCGCAGCATTGGTGGGTGCGGCGCTGGCTGTCTCCGGTGCGATCATGCAGACGGTGTTT
CACAACCCCGTTGGCGGATCCCGGCATTGTGGGTGTGTCCTCCGGTGCAGCTGTTGCAGCT
GTCTTGGCGATTGTCACCGGTGCGAGTTTCTTTGGCCAATGGACCGTTCCTTTTGCGGCC
TTCGTGGGCGCATTGGTCACGGTGGCTGTGGTATATTTGATCGCTAGTTCCCGCGCGATG
GATGGCCGTGGCGCAGATCCGGCCACGTTGGTACTGGTCGGCATGGCTATCACTGCCTTT
TTGGGTGCTGTTATTTCCAGCGCCACTGCGAACGCACCACAAGATTCTGAGCTTCGATCC
GTGACGTTTTGGCTCAACGGCGATCTGGTATCTCGGACGTGGGAACATGTGGGCGTTGCA
ATAATCCCCATTATCGTTGGGTTGATTCTAGCTATCGGCGGTTCCCGCGATCTGAACTTG
TTGCTGCTGGGTGATTCCACAGCGCAAACATCTGGACTCAACGTCAACCGCGCACGCATC
ATTTTGCTAGCACTTGCGGCACTGCTCACCGCCACAGCTGTTGCGGTCTCCGGCACCATT
ACGTTTGTTGGATTGGTAGTACCCCACCTGGTGCGCATTGTTTTAGGTGCCGATCACCGA
GCGTTACTCCCGGCCGCCGCGATTTTGGGCGCCACGTTTGTTATCGTTTCCGACACTGTT
GCCCGCATGATCTTCTCCCCCATCGTCTTGCAAACAGGCGTGGTGGTGGCGTTCATTGGC
TCACCAATTTTCCTTTATTTACTGCTCAGCATGCGCAAGCGACGCGGATTGGGGCTG
```

>RXN03079-downstream
```
TAAAAACTCATGCCTCAATTAGT
```

>RXN03080-upstream
```
CTTGCAAACAGGCGTGGTGGTGGCGTTCATTGGCTCACCAATTTTCCTTTATTTACTGCT
CAGCATGCGCAAGCGACGCGGATTGGGGCTGTAAAAACTC
```

>RXN03080
```
ATGCCTCAATTAGTTGAAATTCGTGATCTCAACGTTGAATTCCCCTCTCGCCATGCAGTG
AAAAACGTGTCTTTTTCTGCACCTGCTGGAAAAGTCACCGCACTGATTGGCCCAAATGGT
GCTGGTAAAAGTACTGCCCTTTCGGCGATTGCAGGATTGGTTGAATCCACCGGCGAGGTA
ATGGTTGGTGGGAGTGGGGTTGCGTCGAAAAGCGCTAAAGCCCGAGCCCGCCTGCTCTCA
CTCGTGCCGCAAAACACCGAGTTGCGCATTGGTTTTAGTGCACGCGACGTTGTCGCGATG
GGCCGCTACCCGCATCGTGGCCGCTTCGCCGTGGAGACCGACGCAGATCGACGCGCCACC
GATGACGCCCTGCGCGCCATCAACGCGCTCGACATCGCCGAGCAGCCCGTCAACGAATTA
TCGGGCGGCCAGCAGCAGCTCATCCACATCGGCCGAGCGCTCGCCCAAGACACCGCCGTC
GTGCTTCTCGACGAGCCCGTCTCCGCCCTTGATCTACGGCACCAAGTTGAAGTCCTTCAA
CTCCTGCGCGCCCGAGCTAATTCCGGCACCACCGTGATCGTCGTCCTTCACGATCTCAAC
CACGTTGCCCGTTGGTGCGACCATGCAGTGTTGATGGCCGACGGCGAAGTTGTCTCCCAA
GGTGACATCCGCGAGGTGCTCGAACCTGCCACACTGTCCACCGTGTACGGACTGCCCATT
GCGGTGCGCGATGATCCCGAAACCAGCTCACTTCGCGTGATCCCGCATCCAAATCCCTTT
```

>RXN03080-downstream
```
TGATTGAAAGTTTGACTTAAAAA
```

>RXN03081-upstream
```
ACGGACTGCCCATTGCGGTGCGCGATGATCCCGAAACCAGCTCACTTCGCGTGATCCCGC
ATCCAAATCCCTTTTGATTGAAAGTTTGACTTAAAAACCC
```

Appendix A, page 127

Attorney Docket No.: BGI-125CP

>RXN03081
ATGAAAAAATCACTCATCGCCATTGTTGCCAGTGCGCTCGTGTTAAGCGGCTGCACCTCT
GATTCTTCTGACTCTTCCGGCACTTCCGGAACTGTGGAAACCACTTCGATTACAACCAGC
GTTGCCGCAGCTGACGGCGCATTCCCACGCACCGTCACACTCGACGATTCCTCCATCACC
TTAGAATCCAAACCAGAGCGCATCGCCGTACTCACCCCAGAGGCAGCATCCTTGGTTCTC
CCCATCACAGGCGCCGACCGCGTCGTGATGACCGCCGAAATGGACACCGCTGACGAAGAA
ACCGCAGCTCTGGCCTCCCAAGTGGAATACCAAGTCAAAAACGGTGGCAGGCTCGACCCC
GAACAAGTTGTCGCCGGCGACCCAGATTTGGTGATCGTCAGTGCGCGTTTCGATACCGAA
CAAGGCACCATCGACATTTTGGAAGGCCTCAACGTCCCG

>RXN03081-downstream
TAGTTAACTTCGATTCAGACGCT

>RXN03082-upstream
CAGAAGCAATCGCAGAAATCGATGCAAACCGCATTCGACATTCGACAAGCCTGCCACCTC
CCCCACTGTGCTCACTTTGATGCAACGCGGACCACGCCAA >RXN03082
ATGGTCATGCCAGAATCTGCCATGCTCACCGGCCTGATCCGCGAAGCCGGCGGCACTCCA
GTGGTAGATTCTCTCGGCGCGGTAGGCACCATCACTGCAGACCCAGAACAAGTTGTTGCG
ATGGCACCTGAGATCATCATCATTCAGGACTTCCAAGGTAAAGGCCGAGAGAACTTCGCT
AATTTCCTCTCCAACCCAGCGCTAGCCAACGTTCCCGCCATTGAAAACGACAAGATTTTC
TACGCCGACACTGTCACCACTGGAGTTACTGCAGGTACCGATATCACCACTGGTCTGCAG
CAAGTGGCAGAAATGCTGAGC >RXN03082-downstream
TAGTTTTGAGATGTTGAAACTAG >RXN03084-upstream
CCACCCCCACGTCTAAGTTTTCCCCTATTTACACACACCTGACCGAAGCTGTAAGGTTTG
CCTAATCTTTTTCAATCTAAAGTCAGGATATTCACAGCCC >RXN03084
ATGTCATCTCGCAGAAAACTCTCCTCCGCACTGATCGTGCTTCTCGCAGCAGCACTACCT
CTTACTGCTTGTTCCTCCAGCTCAGAAGAGGAAGCATCCACCAGCTCTGCGACTCGCGAA
TTCACAGACGCTCACGGAACAACCGAAGTTCCCGAAAATCCTCAGCGCGTCGTTGTCCTC
GAGCCACTTGAGCTAGACACCGCAATCGCCCTCGGAATCACCCCAGTGGGTGCAGCTGTC
GCCAACAACGTCACTGGTATTCCTGCATATCTCGGCGTCGATGGAATCGAGCCTGTCGGC
ACCGTTTCTGAGCCAAATATCGAAGCGATCGCTGCTCTCGAGCCCGACCTGATCCTGGGC
ACCGATTCCCGCCACGCCGAAATCTACGACCGCCTCGAATCCATCGCCCCAACCGTGTTC
ATGACAACCCATGTTGATCCGTGGAAAGACAATGTCGTCTTCATCGGCGATGCATTGGGC
AAGAAGCAGGAATCCGAGGATCTCATCCAAGGCTTTAATGACAAGTGCGAAGAGATCAAG
TCCGAGCATGATGTCGAAGGTAAGACCGTCAACATGATTCGTCCCCGCGACGAGCAAACC
ATGAGCCTATACGGCCCGACCTCATTTGCCGGCAGCTCTTTGGAGTGCGCAGGACTCACC
ATTCCTGATCAGGAATGGAAGGATGACCTCCAGGCCGACATCGCTCCTGAGAACTTCATG
CTCGCCACCGCCGACTACGTCTTTGTCACCGCAACTGATGTCACCGATGAAAATGAGCTC
CCCGAAGTAATCCGAGAAAACCGCGAACAGTTCCCATCACTCACCCTTGTCGATACCAGC
TACTGGGTATCTGGCGTCGGTCCACTTGGCGGCAGCAAAGTCTTGGAAGACATCGATGCC
TTCCTCGACGCACAGCAA >RXN03084-downstream
TAATGTCCACAGCTCTCCCCGAT >RXN03095-upstream
AACGCCTCAATTAGTGCCAGACCTTGCCGACCGCAGACCAAACTTCACCATTTCAAACCA
TCCCTAGCCACAACAACGGCAGTTGTGCAATGATCTGCGT >RXN03095
ATGAATGCAGATAAGAAAATGTGCGGAATGAACCCGGATAGCCAATACGTCGAACTTGCC
GTCGAAGTTTTCGGACTCCTCGCGGACGCCACTCGAGTTCGCATCATCTTGGCACTTCGA
AACAGTGGTGAACTTTCCGTAAACCACCTCGCGGACATCGTCGATAAATCCCCCGCAGCA Appendix A, page 128

Attorney Docket No.: BGI-125CP

```
GTTTCCCAACACCTCGCCCGGCTGCGCATGGCCCGAATCGTGTCCACCCGTCAAGAAGGT
CAACGAGTTTTCTACAAACTCACCAATGAACACGCATCACAGCTAGTCTCCGACGCTATT
TTTCAGGCGGAACACACCATTGCGGACGGCCAGACTCCCCACACCACCACCGAGAACGA
GAACAATCA

>RXN03095-downstream
TGACCACCCACAGTCACCAAGAA

>RXN03097
ATTTCAGCCAGTGCAGGTGCTATAGGTTGGTTAATTTTAGAATATATTTTTAAAAAGACG
ACAAGTTTACTTGGACTTTTACTCGGTGCATTAGCAGGATTAGTTGTTATTACTCCTGCA
GCAGGATATGTAACATATCTTAGTGCAACAATAATGGCTTTAATAGGAGGTATCTGTTGT
TATATTGTCATTAATTACATCAAGGTAAAACTAAAATATCATGATGCATTAGATGCATTT
GGTATTCATGGTGTTGGTGGTATTATTGGTGCTGTTTTAACAGCAGTTTTCAAAGTAAA
AAAGCCAATCCTGACATTGAGAATGGCTTTATTTATACTGGTGACATACATATTATACTT
GTACAAATATTATGTGTAACAGCAGTTGTAATTTTTAGTATCGTCATGACGTTTATTATT
GCGAAAGTAATTAAATTAATTACACCATTATCTGTTACGGAACAAGAAACGAATATAGGA
TTAGACAAGATTGTTCACGGTGAACATGCTTACTTTGAAGGTGAGCTAAATAGATTCAAT
AAACATATTCGATAT

>RXN03097-downstream
TAGAATATATTTACATAGAATAT

>RXN03103-upstream
ATCTTCAGAGTCACTTCTTTCAGTGTCATTTTTCTCGGCCCTAATCCCCCGCTGGAGTTC
AATCAGCGATTGCAACCTTTTAGATATATAAGGAGACAAC >RXN03103
ATGTCTGCAAAGCGTACTTTTACCCGTATCGGTGCGATTCTTGGAGCAACTGCACTTGCC
GGAGTTACCCTCACCGCCTGTGGTGATTCAAGCGGTGGCGACGGATTCCTCGCAGCCATT
GAAAATGGTTCTGTCAATGTCGGCACCAAATACGATCAGCCTGGTCTTGGCCTCCGCAAC
CCAGACAACTCCATGAGCGGTCTCGACGTGGATGTTGCTGAATACGTAATTCAACTCCAT
CGC >RXN03103-downstream
TGATGACAAG >RXN03109-upstream
ACTGGCGCTTCCCGATGGTCAATCATTGGCCTTTGGTGCCCAAACTGGCGAGTTGTTGCT
CCGCGCATCCCGCGAACTGTATGTGCAGGGCGGCGAGTAG >RXN03109
ATGGTTGTGAAGGAGGTTGACGTCGAAAAGCAAAAAGCTGGCCGGGTGCCTGGTGCTATA
GCTAAGCGTCGGACCGTGCGGATTGTGCTGTTTGTCGCGCTGGGCGCGATCGTGATTGCG
GCGTCGCTGTGGTCGATTCTGGTCGGCCAATACACCATCCCGATTCGCGATCTACCTGCG
ATTTTAGCCTCCGGTCCGACCGGTGCGCAGACGATGGCGGAACAAGTCGTGTGGCAAATC
CGCATGCCGCGCATCGTGCTGGGACTGCTCGTGGGTGCCGCTTTGGGCGTGGCCGGCGCG
CTGTTGCAGGCGGTGTTTTCCAACCCGCTGGCGGAACCGTCGATCATCGGCGTGACCTCC
GGCGCGGGCGTGGGTGCTGCTGCGGTGATCGTGTTTAACCTGACATTTTTGGGCACATCC
ACCGTCGCAGTCGGCGCGTTTATTACCGCGGTGATCACCACGATTTTGGTATATCAGCTG
GCCAGAAGCCGTGGACGTGTGCAAGTGATCAACCTGATCCTGACAGGCATAGCCATTAAT
GCAGTATCCGGCGCGCTGACCTCAGTTCTTGATCTACATCGCGCCGACGAGCTCCCGCGA
AGAAATATTTTCTGCAGATGGGTTCCTCACGGCTCGCATGGCGCACGTCAACGT >RXN03110-upstream
AATGAGTGAACCTGCGCTTGAACTATACCCCCTGGGGTATTACTGTAGATTCTCAATACC
CCGAGGGGTATCTAGTTTTTACGTTGAGAAGGAGAGCTCA >RXN03110
GTGCTTATTGAACGCATCTACGACGAAGACCTTGCGCAGGCCAGCTATTTCATTGGCTGC
CAAGCCCACAACACCGCAGTCGTGGTTGATCCGCGTCGCGATATTGCCGTCTATCTGGAC
```

Appendix A, page 129

Attorney Docket No.: BGI-125CP

```
ATGGCCAAGAAAAACGGAATGGAGATTGTTGGAGTTACCGAAACCCATATCCATGCGGAC
TATTTGTCAGGAACCCGTGAGTTAGCTGCTGCAACTAATGCCACCATGTACGTCTCAGGG
GAGGGCGGCGCCGATTGGCAGTATGAATTCGACGCCGAGCGAATATGCGACGGCAGCGAG
ATTCGCCTGGGAAATCTGGTGCTCACAGCTGTTCACACCCCAGGCCATACCCCGGAACAC
TTATCGTTCCTGCTGAAGGACGGCGCGTTCGCAGATGAGCCAGGATTCATGCTCACTGGC
GATTTCGTTTTCGCGGGTGATCTTGGCCGACCAGATTTGCTCGATGAAGCAGCTGGGGGA
GTGGACACTCGTTTTGAGGGGGCTCGCCAAATGTTCAAGAGCTTGAAGGAAAAATTCCTG
ACATTGCCTGATCACATCCAGATCTTCCCTGGTCATGGTTCCGGTTCCGCGTGTGGCAAA
GCCTTGGGTTCGGTTCCTTCAACAACACTTGGATATGAACGTCAATTTGCGTGGTGGGGA
AAGTATCTGGAGGCAGATGATGAACAAGGATTCATTGAGCTTCTGGAAGGCCAACCT
GATGCACCTGCATACTTCGGCAGGATGAAGAGGCAAAATAGGCAAGGGCCCGCAATTATG
GGCGCTCGCGAGCTGTTGCCACAGCTGGAAGCTTCTGATCTGCACGACGTCATTGTTGTT
GATACCCGCTCAGCCGATGAAGTTCACCAGGGCACTGTAGCTGGTGCAGTGAATATTCCT
GCGGGCAATTCGATGGCGAAATTTGGCTCGTGGACCGTTGATCCCGAGAAGGATTCCCGA
GCTTTGGTTCTGCTCGCGGCAAGCCAAATTGGTGCCATGGAGATGTGGGACCACATGGTT
CGCGTGGGAATCGATAATGTTGCTGGTTTTATCACCAACTTTGATGGGGTGGACCTAGTT
GCACCGCAAACTGTGTCCCCAGATCAGCTGGATGAATTGGAATACGATCTACTTCTTGAT
GTCCGCAACCGCAGTGAAGTCGAAGAAGGCTACATCCCAGGAGCACTCCATATTAATGGT
GCATCCGTGCTGTGGAATCTGGAGAAACTGCCACGTGACGGAAAGATCGTGAGCTACTGC
AAGAGTGGAACACGCAGCTCAATCGCCGCAAGCACCCTGCGTAATGCTGGTTTTGATGTG
GTGGAACTTCAAGGATCCTATGACAACTGGGTCCGGCACAAC

>RXN03111-upstream
CGTGACCGAATTGAGCAGGAACTTCGGGGCCAGCCGACTGATTAACCGCTTTGGCCAGGA
GCCTTTTGCCTTCGCTTTCGCCGGCCAAGGATATGACTGG >RXN03111
TTGAAGACCCTTCGTGCCGCGGTTGCCGCAGGTGCAGGCACCAATGTTAGTGACATCGTC
GAGCGCGCAAATGCGCTGCTTGCACTAGTTGCAGATGATCTCATTGGCACCCTTCCATTT
GGTTTCGATCCAGTGGCTTGGGCTAACAACTCCGAAGATCCAGCTTTCGATACTGCACAA
TCTGCAGTGAGCGTGCCGGGTATCTTTGTCTCCCAGATCGCAACCCTGGATTCCCTTGAG
GCGCAGCGCCTTGATGTGGATCAGGCTGTGTCCAGCATTGGTCATTCCCAGGGCGTATTG
GGCGTGCACCTGCTCAATGATGCGACTCGTGCTGATGAACTCGTTGCCATTGCGCAGTTG
ATCGGTGCAGCGATCACCCGCACCGCACGCATGACGGGCCTGATCGCGCAGGGCGACAAC
ATGCCGATGCTGTCGATCGCCGGAATTTCCCGCGAACAGCTTCAGCAAGCTATCGACGCG
GCCTGCGCCGAAGTCCCTGCGGAGATCCGCCCGGTTATCGGTCTGCGCAACTCACGCGAT
TCTTATGTTTTGGTTGGCCGCCCAGACGACAACGCTCGCGTTGTTAAGGTCATTGAGGCA
ATGGCTGCCAAGGATAAGAAGGCCATTGAAGATAAGCTGCGCGGCGGTTCCGCGTTCAGC
CCCCGTATTACTCCGCTGAAGGTGCAGGCTGCTTTCCATCACCCAGCTATGAACATGGCT
GTGGAGCAGACCGTGGCGTGGGCAACCACTGCTGGTTTGGATGTGGAACTCACCCGCGAG
ATCGCCGCTGATGTTTTGGTTAACCCTGTCGATTGGGTAGCACGCGTCAACGAAGCGTAT
GAGGCTGGCGCTCGCTGGTTCCTCGACGTTGGACCAGATGGTGGCATCGTTAAGCTGACT
GCCAACATCCTTGAGGGCCGCCGGCGCGGATTCCTTCTATGTTGGTGACGCCGCAGGCCAG
GCCAAGATATTTGATGCTGGCATGGCACCTGAACTTCCAGTGGATTACCAGGAGTTCGCA
CCACGCGTTGAGCACGTTGATGGAACCCCACGCCTGGTTACCAAGTTCACTGAGCTGACC
GGCCGCACCCCAATGATGCTGGCTGGCATGACCCCAACCACCGTTGACCCTGCCATTGTT
GCAGCCGCTGCAAACGGTGGACACTGGGCTGAGCTCGCTGGTGGCGGACAGGTTACCCCA
GAGCTGCTGGAAACCCACATCGCACAGCTCACCGACATGCTTGAGCCAGGTATCAACGCC
CAGTTCAACTCCATGTTCTTGGATCCATACCTGTGGAAGATGCAGATTGGTGGCAAGCGC
CTTGTTCCTAAGGCCCGCGCTAATGGTGCATCCATCGACGGCATCGTCATCACCGCCGGC
ATTCCTGAAAAGGATGAAGCTGTTGCATTGGTCAAGGAACTGATGCGTGATGGTTTCCCT
TGGATCGCATTCAAGCCAGGTGCCATCAAGCAGGTTAACTCTGTGTTGGCTATCGCTAAG
GAAGTTCCAGAACTCCCCATCATCATTCAGATTGAGGGTGGCGTTGCAGGTGGACACCAC
TCTTGGGAAGACCTCGATGAGCTGCTGATCGCCACCTACGGCAAGGTCCGCGCACTGGAT
AACGTGGTGCTGTGTGTCGGCGGTGGCATTGGCTCACCTGAGCGCGCTGCTGATTACGTC
ACCGGTTCCTGGTCCACTTCCTACGGCCTGCCAGCTATGCCTGTTGATGGCATCTTGGTG
GGTACCGCTGCGATGGCAACCAAGGAAGCAACCACCTCCCAGGCCGTCAAGGAACTTCTT
GTTTCCACCCAGGGCTCTGATGAATGGGTTCCTGCTGGTGGCGCAAAGAACGGAATGGCA
TCTGGCCGTTCCCAGCTTGGCGCAGACATCCACGAGATCGACAACTCCTTTGCTAAGGCT
GGACGCCTTCTTGATGAGGTTGCAGGCGATGAGACGGCTGTGCAGGCGCGCCGGGATGAG
ATCATTGAAGCGATTGGCAAGACCGCCAAGGTGTACTTCGGTGACATCGGATCCATGACT
```

```
TACGAGCAGTGGCTCAACCGCTACCTCGAGCTGTCTGGCCCTGTTGATGGTCAGTGGATT
GATGCTTCCTGGGCTGCACGTTTTGCCCAGATGCTGGAGCGTGCCGAGGCGCGTTTGATC
GAGCAGGATCATGGCCAATTTGAGCCAAGCCTGACGGTGGAGGATGGCGTCGACAAGCTT
GTTGCTGCTTACCCGCATGCCGCAACCGACCTGCTCACCCCGGCTGATGTCGCCTGGTTC
TTGGGCCTGTGCCGCACGCCGGGCAAGCCTGTGAACTTTGTGCCCGTCATTGATAAGGAC
GTGCGTCGCTGGTGGCGCTCGGACTCCCTGTGGCAGTCCCACGATGATCGCTACACCGCT
GATCAGGTGGCTATTATCCCTGGTGTCGTCGCCGTTGCTGGCATCACCAAGGCCAACGAA
CCTGTCGCTGACCTGCTTGATCGCTTTGTCGACGCCACCATCGAGCGCATCGATGAGCAC
GATTCCCGCTCCCGCGACATCATGGGCAAAGTGCTTTCCTCACCTGGCACATTCTGGGCT
GGCCGCAACATCCCATCGGTGATCCACAGCCTTGGGCATGCTGACAAGTGGTCCCGCTCC
GAATTCGAAGCATTCCATAGCCCAACCGGCGCCAACTTGGTGTACGAAGACGCCGAGCAC
GCGATGCTGACTGTGCCTTTGGCGGGTTCCACCGCATTCGGCACCACCGCTGAGCTGAAA
ATCCGTTTCACCAGCCCCATCGACGCTCTGCCAAGCGCTGTCCCACTGGTCACCCAGGAA
GACGCTGAAGCCGCGATGGGTGAACTGACCCGCATCGCAGCTGGCGGCACCCTGGCAACT
GTGAACAATGGCACCGCTACCTGGGAAACCTCCGTCGATGCCGGCGTCATCGCTGACTAC
AACAACGTCACCGCAGGCTACCTGCCAGCATCCGTTGTTCCTGCACACACCGCACCTGAC
GTGCTGGTTGGCCGCGCATGGCCAGCAGTTTTCGCTGCCGTAAAGTCCGCAGTCATCCCA
GGCACCGATTCCGCATCCGTTGTGGAAGGCATGCTGTCCCTGGTTCACCTGGAGCACCAC
ATTGTGCTCAAGTCCGATGTCCCAACCGACGGCGCGCTGAAGGTTTCCGCGACTGCCGAT
GAGGTAGTCGATACCGACCTGGGTCGCCTCGTGATCGTGCGCGCAGAAATCGCCGACGCA
GAAGGCAACCTGATTGCTACGTTGGCTGAGCGTTTCGCGATCCGCGGACGCAAGGGCAAC
GCTGTCGCACGCACCAACACCTCCGCACTGCCAACCACCGTGGACACCCCACGCTCAGCT
CGCGCAGTGGCAACCGTTGTTGCACCTGAATCCATGCGCCCATTCGCTGTGATCTCCGGT
GACCGCAACCCAATTCACGTCTCTGATGTTGCGGCTTCCCTGGCTGGTCTGCCAGGTGTG
ATCGTGCACGGCATGTGGACCTCTGCCATCGGTGAACTGATCGCCGGTGCAGCATTCAAC
GATGAGCAGATCCAAACTCCCGCAGCCAAGGTCGTGGAATACACCGCAACCATGCTGGCA
CCAGTTCTTCCAGGTGAAGAAATTGAGTTCAGCGTTGAGCGCTCCGCAGTGGACAACCGC
CCAGGAATGGGAGAGGTCCGCACCGTTACCGCAACCGTCAACGGCAACTTAGTGCTTACC
GCCACCGCTGTTGTGGCAGCTCCATCTACTTTCTACGCATTCCCAGGCCAGGGCATTCAG
TCCCAGGGCATGGGTATGGAAGCACGCCGTAACTCTCAGGCAGCTCGCGCTATCTGGGAC
CGCGCCGATGCACACACCCGCAATAAGCTGGGCTTCTCCATCGTGGAAATCGTGGAAAAC
AACCCACGCGAAGTAACCGTGGCAGGGGAGAAGTTCTTCCACCCAGACGGCGTTTTGTAC
CTCACCCAGTTCACCCAGGTGGGCATGGCAACTCTGGGCGTTGCTCAGATCGCTGAAATG
CGTGAAGCACATGCCTTGAACCAGCGTGCATACTTTGCTGGACACTCCGTTGGTGAGTAC
AACGCGCTTGCTGCATATGCTGGTGTGCTGTCCCTGGAATCCGTTCTGTGGAGATCGTTTAC
CGTCGTGGCTTGACCATGCACCGCTTGGTGGATCGCGATGAAAACGGTCTGTCCAACTAC
GCGCTCGCAGCTCTTCGCCCCAACAAGATGGGTCTGACCGCAGACAACGTTTTCGATTAC
GTTGCGTCTGTTTCCGAAGCTTCCGGTGAATTCCTGGAGATCGTTAACTACAACTTGGCT
GGCCTGCAGTACGCAGTTGCTGGAACCCAGGCTGGTCTTGCCGCCCTTCGTGCCGATGTT
GAGAACCGTGCACCAGGTCAGCGTGCCTTCATTTTGATCCCTGGCATTGACGTGCCATTC
CACTCCTCCAAGCTGCGCGACGGTGTGGGCGCGTTCCGTGAGCACCTTGATTCCCTGATC
CCAGCTGAGCTGGATCTGGATGTGCTGGTTGGCCGCTACATTCCAAACTTGGTGGCTCGC
CCATTCGAACTCACTGAAGAGTTCGTGGCATCCATGGCAGAAGTGGTGGAGTCCACCTAT
GTCAATGAGATCTTGGCTGATTTCAAGGCTGCTTCCGCCGATAAGCAGAAGCTTGCCCGC
ACGTTGCTTATTGAGCTGCTTGCATGGCAGTTCGCATCACCTGTGCGCTGGATCGAGACT
CAGGATCTGTTGATCAAGGGCCTTCAAGCTGAGCGTTTCGTGGAGGTCGGTGTTGGCTCT
GCTCCAACGCTTGCCAACATGATGGGCCAGACCCTGCGCCTTCCTCAGTACGCGGACGCC
ACCATTGAGGTGTTAAACATTGAGCGCGATCGCCCAGTTGTGTTCGCTACCGATGAGGTT
GTGCGTGAAGTGGCGGTTGAAGAGACCCCAGCAGCTCCTGCAGAAACCACTGAAACCCCA
GCAACCCCAGCAACCCCAGCCCCTGTTGCAGCTGCAGCCCCTGCCACCGGCGGCCCTCGC
CCAGATGACATCAGCTTCACTCCTTCTGATGCCACTGAAATGCTCATCGCTATCTGGACC
AAGGTTCGCCCAGATCAGATGGGTGCCACTGATTCCATCGAGACCCTGGTTGAGGGCGTG
TCCTCTCGCCGTAACCAGCTCCTGCTGGATCTTGGTGTGGAGTTCGGCCTCGGCGCAATT
GACGGAGCAGCCGATGCTGAGCTCGGTGATCTAAAGGTCACCGTGTCCAAGATGGCTAAG
GGCTACAAGGCGTTTGGCCCTGTGCTCTCCGATGCTGCAGCTGATGCCCTGCGTCGCCTC
ACTGGTCCTACCGGTAAGCGCCCGGGATACATCGCAGAGCGCGTCACCGGCACGTGGGAA
TTGGGCCAGGGCTGGGCTGACCACGTGGTCGCTGAAGTTGTGATCGGCGCCCGCGAAGGC
GCATCCCTGCGCGGCGGCGACCTGGCGTCACTGTCTCCTGCAAGCCCAGCGTCTGCATCA
GATCTTGATTCGCTTATCGACGCAGCCGTCCAGGCCGTAGCCTCCCGCCGCGGCGTTGCG
GTCTCCCTGCCTTCAGCAGGCGGCGCTGCCGGTGGCGTGGTTGATTCCGCAGCTCTTGGC
GAGTTTGCAGAGCAGGTCACCGGACACGATGGTGTGCTTGCTCAGGCAGCCCGCACCATC
```

```
TTGACCCAGTTGGGTCTTGATAAGCCAGCAACCGTTTCCGTGGAAGACACCGCAGAGGAA
GACCTCTACGAGTTGGTCTCCAAGGAACTCGGTTCTGATTGGCCACGTCAGGTTGCACCA
AGCTTCGATGAAGAAAAGGTTGTTCTGCTTGATGACCGTTGGGCTTCTGCGCGTGAGGAT
CTCTCCGCGTTGCTCTTGGCGAACTCGCAGCAACTGATATCGATGTCACAGGCGCAGGCG
AAGCTGTTGCAGCACAAGCTGAATTCTTTGGACTTGATGATCTCGCAGCTAGGCTCGCGA
ACAAAGCTTCTTGGACTACGCCGACAATGTTGCGGC

>RXN03126-upstream
TCTTGGACAACATTACCCCACACACGGGACACTCAAACGTGCATGAATTCACCTGTCGTC
GATACCCAAAAATCACTCCACCACCACTAGGGTGTCTTAT >RXN03126
GTGCAGGAACAATCGAAGCAGAAAGACCTCCAGGCTGATATCGCCAGAATCACTGCCGTG
AAATCGGACACAGTTCCGAATTCCCAGTCAATGACCTTTGGCGCTGCCTGGAACGATATC
GTCCGCGGATTCAAGCAACATGAGTTGTGGCTGCAACTCGGCTGGCAAGACATTAAGCAA
CGCTACCGGCGATCCGTCCTTGGGCCCCTGTGGATCACCATCGCCACCGGTGTCATGGCG
CTCGCCCTCGGCTTGCTGTACTCCGTGCTGTTCAAAATCCCCATCGCGGAATTTCTGCCC
CACGTCACCGTCGGCCTGATCATTTGGAACTTCATCTCCGGATGCATCAAAGAAGGCTCC
GACATCTTCATAGATAACGAGGGACTCATCAAACAGCTCCCCTCGGCGCTGTCCGTCCAC
GTGTACAGACTCGTGTGGAAACAAGCCCTCTTCCTCGCCCACAACCTGGTCATCTGGGTC
ATTCTCATGATGATCTTCCCCCGACCCCTCGGCTGGGACGTCCTCCTGATCATCCCCGCA
ATGTTCCTCCTGGTGATCAACGGCGTGTGGGTAGTCATGTTCTTCGGCATCATCGCCACC
CGCTACCGCGACGTCTCCCCGTTGCTAGAAGCCGGAACCCAACTCCTCTTCTACGTCACC
CCCATCGTCTGGATGACTTCCACCCTGCAATCCCAGAGCGCAGAAATCGGCAACCGCGCA
CGCCTCGCCGAACTCAACCCGCTCTACCACTACCTCGAAATTGTCCGCGCCCCCATGGTC
GGCGCCGACCTCCCCGCCTACCACTGGTGGATCGTCCTCGCCTTCACATTCGTCGGCCTT
GGCCTTGCTCTCCTCGCGATGAAGCAATGGCGATTCCGCGTCAGCTACTGGGTA >RXN03126-downstream
TAAGGAGCACCACATGGTATCCA >RXN03132-upstream
TAACTTATTTATACATAAAAACACAATAAAAACCGCACACGCGGCGAAACTTCAATAAAT
CCCTAGACTGCAAAAAATGGTTAGGCTAACCTTATTTCCA >RXN03132
ATGAATGTGAATCAACAGTTGGGAGCCCGCACCGCCATGAACCACCCTGAGACCGCAACC
GTCCTTCGCTCCATCTCTGACATGGTTAGCACCGAAACCAATCCGCGCCGTAAAAGCCGC
CTCGAGCAGCTCATTTACGCCACCGCCAGCGCCTGGCCCCACTACCCCATTGCCCACGCA
GCCCAGGCCGCGGTGCAATTAGCCAGGCCAATGCGGGTTTTTGAGCTCCAGAGCTTTGAA
GGCGTCAAGCACGCACTCCACCACATCGATCTTCGCCCCGCCCTCGAATGGGACATCATG
GGATTTCCCGAATCCCCCGACACGCTGCCCATTTTGCTCAGTGACCTGCGCGACCCCCCT
TACGCCACCACTGCTGTGCCACCTCAATCCACGCCACGCTCCGCTCACCGATCCACACAT >RXN03132-downstream
TGACGCTTCCAGGCGCCACCGCG >RXN03157
GGCCACCTCGACATCGTGACCCGCGCCGCCGCGCAATTTAGCGAAGTCACCATCTTGGTC
ACCGCCAACCCCAACAAAAACTCAGGACTGTTCACCGTCGCAGAACGCATGGATCTCATC
CGCGAATCCACCGCACACCTGGACAACGTAAAAGTAGACACTTGGGCCTCACTGCTCGTG
GATTACACCACCGAACATGGCATCGGCGCCCTAGTCAAAGGCCTGCGAAGCTCCCTCGAC
TACGAATACGAGCTCCCCATGGCACAGATGAACAGGCGACTCACGGGCGTAGACACCTTC
TTCCTCCTCACCGACGAGAAATACGGCTACGTCAGCTCCACACTGTGCAAAGAAGTTGCC
CGCTTCGGTGGCGATGTCTCCGGCCTCCTACCTGAGGTAGTGGCAAAAGCCGTGACAGAA
AAATACAGCAACCAGCAC >RXN03157-downstream
TAGTTTCTTTTGCATCAAGCGTC >RXN03160-upstream
```

Attorney Docket No.: BGI-125CP

```
GAGCATATGGTGCGCGCGGCCGATATGCTGATCAATTCCAACCCCGATCCGCACGCTTAA
CTTCTGCCAAAAAGTCGTTTTGACCATAAGCTAAGCGATT

>RXN03160
GTGAATCGAATTGCAGAAATCGCACGCAGTTTCGGCGTGCTGGGCTTCAGCGCTTTCGGC
GGCCCCACCGCGCACCTCGGATATTTCCGCACGGAATTCGTGGAGCGGCGGCGCTGGCTG
GATGATCGCCAATATTCCGAGATCGTAGCGCTCAGCCAACTACTTCCCGGACCTGGATCG
TCGCAGGTCGGTATGATGCTGGGCTACCACCGCGCCGGTTTTTCCGGCATGGCGATCGCC
TGGCTCATGTTTACCTGGCCCTCATTGGCGCTCATGGCGGCGTTCGCCCTGCTTTTTGAT
GCGACCTCCGCCAGCTGGACGCTCGGCCTGCTCGCCGCAGCGGTCGCCGTCGTTTTCAAA
CGCAGTCACCGGGCATGGCGCGGTTCAATGGCTTCCACGCCGGGGCGCCGGCCACCATCG
GGGGTCGGCCTCGGGGCATCGCGGGTGCTCGGCCCTCCCCAACGGGGT

>RXN03160-downstream
TAACACACCTTGGGGTTCAATCA

>RXN03164-upstream
CTTTTTTGCATCCAGATGCACAAAGCCGTGGCACAAACGAGACAAACTGAGCACAATGGC
TGTCATGGCATATCAACCAGCAGACAATCGCTATGACGAC >RXN03164
ATGATCTACCGCAGGGTGGGAAATTCTGGGCTGAAGCTTCCGGCAATTTCGCTTGGGCTG
TGGCACAACTTCGGTGATGACAAGCCGCTTTCAACGCAGCGCAGCATTATTCACCGCGCG
TTTGATAGGGGAGTCACTCACTTCGATTTGGCTAATAACTATGGACCTCCAGCAGGTTCC
GCAGAGACCAACTTTGGCAGGATTTTGCGTGAGGATCTCAAAAGCCACCGCGATGAGTTG
ATCATTTCTTCCAAGGCGGGTTGGGATATGTGGCCTGGACCTTATGGTTTTGGTGGTTCC
CGAAAGTATCTAGTGAGTTCCCTTGATCAGTCCCTGACTCGCCTCGGCTTGGATTACGTG
GATATTTTCTATCATCACCGCCCGGATCCAGATACTCCTTTGGAAGAAACCATGTACGCA
TTGCGTGACATTGTTGCGTCTGGAAAGGCTCTTTACGTGGGTATTTCTTCCTACGGTCCA
GAGCTCACAGCGGAGGCGGCTGAGTTCATGGCGGAGGAGGGCTGCCCGCTTCTGATTCAT
CAGCCAAGCTATTCCATCATTAATCGTTGGGTGAGGAACCGGGCGATGACGGTGAGAAC
TTGTTGCAGTCAGCTGCCAACAATGGTCTTGGCGTCATTGCTTTCTCACCACTTGCGCAG
GGCCTGCTCACGGACAAATATCTCGATGGAATTCCAGAGGGTTCCCGCGCCAGCCAGGGT
AAGTCCCTGTCTGAGGGCATGTTGAACGTGAACAATATTGATATGGTCCGCAAGCTCAAT
GACATCGCCCAGGAACGCGGGCAGTCACTTGCGCAGATGGCGCTTGCATGGGTGCTGCGC
GAGCAAAGAGAGTACGGCGCCGGATTACCG >RXN03164-downstream
TGACCAGTGCATTGATTGGTGCT >RXN03183
GAAGCCGAAGCAACCGCAGGCAAATTCGAAGTACAGCCCCTCGTAGGTAAAGACGGCGTC
GGCGTATCCACCCTTGGTGGCTACAACAACGGCATCAACGTCAACTCCGAAAACAAGGCA
ACCGCCCGCGACTTCATCGAATTCATCATCAACGAAGAGAACCAAACCTGGTTCGCGGAC
AACTCCTTCCCACCAGTTCTGGCATCCATCTACGATGATGAGTCCCTTGTTGAGCAGTAC
CCATACCTGCCAGCACTGAAGGAATCCCTGGAAAACGCAGCACCACGCCCAGTGTCTCCT
TTCTACCCAGCCATCTCCAAGGCAATCCAGGACAACGCCTACGCAGCGCTTAACGGCAAC
GTCGACGTTGACCAGGCAACCACCGATATGAAGGCAGCGATCGAAAACGCTTCCAGC >RXN03183-downstream
TAGTTCGGTAATTTAGTTCATTC RXC00354 - 5'-Region
GGCTTGTCGGTAAGGCTGCAGGGTAGCGGGAGTTTCCTTCAGATTGGAAGTTCTTTAATTTTCTCGATT
ATGTACCTCATTTACGCGTAAAGTTTGGGGC RXC00354 - coding Region
ATGGGAAAGTTACTTTTCGTAGACATCGGTGGCACACTGCTGGATTACTCAAATGAAGTTCCGCGTTCG
GCCGTTGACGCGATCCGTAAGGCACGCGCCAAAGGACACCGCGTGTACTTGAGCTCTGGTCGAAGCAGC
GCTGAGGTGACTTCTCAGTTGTGGGATATCGGAGTGGATGGCCTCATTGGCGCAAATGGTGGATATGTG
GAAAGCGCACAGGAGTCTGTGTTCCACCGCCGTTTGTCGGGTGAGGAGACCCGCCACATTGTGGAGTGG
```

Appendix A, page 133

Attorney Docket No.: BGI-125CP

```
CTCTACAACCGTGGTTTGGAGTTTTATCTCGAGTCCAACAACGGTTTGTATGCAAGCCGTGGTTTCCGT
GAGGCTTCTAAGCCAGTGCTGTCTCGCCTTTCGGAGAAGACCGACGTGACAGTCGATAGCATGTACCCG
GATATGTTCTGGGGCGCGAGCCTTGATCGTGACGATGTGAACAAGATCAGTTACATCTTCAATTCTCAG
GAAGATTTGGACGCAGCGCGTGAGGCGTTCCCTAACCTGGAGCACACCACGTGGGGTGGTCAGACGGGT
GCGTTGTTCGGCACGATCGGTGTGTCTGTCAACAAGAAGATCGGCGTGGATCGCCTGCTGAAGTACCTG
AACGCAGATCGCGCAAACACCATTGCGTTCGGCGACAGCGATGAGGATCTCTCCCTATTTGAGGCGAGC
GCTTACGGCGTCGCGATGGGCGAGGCCACCGAATCGCTCAAGGCTGCTGCTGACCTGGTCACGGATGCT
GTTGGGCAGGACGGCTTGCGCAATGCGTTTTTAAAGCTTGAGCTTATCGACGCC

RXC00354 - 3'-Region
TGACCCCATCAAAGAACTTCCCA

RXC01748 - 5'-Region
ATCACCAAATGTGGCGGTTTTGCGTCGAAAAGCGTGCTCTTTCTACACCTCTTTGAGGTTCATTTTCGC
GGTTTCCTCACAATCGCCTATTGTTAAGTAC RXC01748 - coding Region
ATGGCAGACGCGAAAAAGCAGGCGGATAAAGCCGCCAAGAAGCAGGTAAGAGCAGCCAAGAAGGCACAG
CGCAAGGAGACTCGCTCACAAATGTGGCAGGTCTTCAACATGCAACGCAAGCAGGATAAGGCTCTTATT
CCGCTTCTGTTGCTCGCTATTCTTGGTATCCCGCTGGTCCTTTTCCTCATCGGTTTGATTTGGGGTGGT
CAGTGGTGGATGCTTCCGATCGGCATTGCTGCAGGTGTTGTAGCTGCAATGTTTATTTTCACCCGTCGC
GTTGAGCGTGACGTGTACAAGCGCGCCGAAGGTCAGCAGGGTGCTGCTGGTTGGGCGTGGAGAACCTC
CGCTCTGGCGTGGGCATGACCTGGCGCACCAAGACCGCTGTTGCAGTGACCACTCAGATGGATGCAGTG
CACCGCGTCATTGGTCTGTGTGGTGTTGTGCTGGTCGGCGAGGGCTCCCCTCACCGCCTGAAGCCAATG
CTTGCGCAGCAAAAGAAGCGCCTGAACCGCGTGGCACCTGGTGTTCCAGTGTATGAAATCATCACGGGC
AACGGCGAAGGCCAGACCCCTATCGCGAAGCTGCAGCGTGAACTGGTCAAGCTGCCTCGCAACTACAAG
AAGAACGACGTCGCTGCCCTGGCCGCTCGCATTGAGGCTATGGACAATGTCGGAAACGCTCCTGGCGGA
TCTTTGCCTAAGGGTCCATTGCCAAAGGGCGCAAGCATGTCCGGTATGAACCGCCGCGCTCGCCGACAG
GCTGAACGCAAGGGCGAGGCT RXC01748 - 3'-Region
TAAAGCCTTTTCGCTTTCGCGTC RXC01749 - 5'-Region
GGTTTTTGCGTGCTCTGGTTTAGGGACTGGTTTTGGGAACGTGCCCAGTTCCACATCAAATAACGCTGA
GGTCGTACTTAATCCATGAGATCATGAATGG RXC01749 - coding Region
GTGAGCTTCCTTGTAGAAAATCAATTACTCGCGTTGGTTGTCATCATGACGGTCGGACTATTGCTCGGC
CGCATCAAAATTTTCGGGTTCCGTCTCGGCGTCGCCGCTGTACTGTTTGTAGGTCTAGCGCTATCCACC
ATTGAGCCGGATATTTCCGTCCCATCCCTCATTTACGTGGTTGGACTGTCGCTTTTTGTCTACACGATC
GGTCTGGAAGCCGGCCCTGGATTCTTCACCTCCATGAAAACCACTGGTCTGCGCAACAACGCACTGACC
TTGGGCGCCATCATCGCCACCACGGCACTCGCATGGGCACTCATCACAGTTTTGAACATCGATGCCGCC
TCCGGCGCCGGCATGCTCACCGGCGCGCTCACCAACACCCCAGCCATGGCCGCAGTTGTTGACGCACTT
CCTTCGCTTATCGACGACACCGGCCAGCTTCACCTCATCGCCGAGCTGCCCGTCGTCGCATATTCCTTG
GCATACCCCCTCGGTGTGCTCATCGTTATTCTCTCCATCGCCATCTTCAGCTCTGTGTTCAAAGTCGAC
CACAACAAAGAAGCCGAAGAAGCGGGCGTTGCGGTCCAGGAACTCAAAGGCCGTCGCATCCGCGTCACC
GTCGCTGATCTTCCAGCCCTGGAGAACATCCCAGAGCTGCTCAACCTCCACGTCATTGTGTCCCGAGTG
GAACGAGACGGTGAGCAATTCATCCCGCTTTATGGCGAACACGCACGCATCGGCGATGTCTTAACAGTG
GTGGGTGCCGATGAAGAACTCAACCGCGCGGAAAAAGCCATCGGTGAACTCATTGACGGCGACCCCTAC
AGCAATGTGGAACTTGATTACCGACGCATCTTCGTCTCAAACACAGCAGTCGTGGGCACTCCCCTATCC
AAGCTCCAGCCACTGTTTAAAGACATGCTGATCACCCGCATCAGGCGCGGCGACACAGATTTGGTGGCC
TCCTCCGACATGACTTTGCAGCTCGGTGACCGTGTCCGCGTTGTCGCACCAGCAGAAAAACTCCGCGAA
GCAACCCAATTGCTCGGCGATTCCTACAAGAAACTCTCCGATTTCAACCTGCTCCCACTCGCTGCCGGC
CTCATGATCGGTGTGCTTGTCGGCATGGTGGAGTTCCCACTACCAGGTGGAAGCTCCCTGAACTGGGT
AACGCAGGTGGACCGCTAGTTGTTGCGCTGCTGCTCGGCATGATCAATCGCACAGGCAAGTTCGTCTGG
CAAATCCCCTACGGAGCAAACCTTGCCCTTCGCCAACTGGGCATCACACTATTTTTGGCTGCCATCGGT
ACCTCAGCGGGCGCAGGATTTCGATCAGCGATCAGCGACCCCCAATCACTCACCATCATCGGCTTCGGT
GCGCTGCTCACTTTGTTCATCTCCATCACGGTGCTGTTCGTTGGCCACAAACTGATGAAAATCCCCTTC
GGTGAAACCGCTGGCATCCTCGCCGGTACGCAAACCCACCCTGCTGTGCTGAGTTATGTGTCAGATGCC
```

Attorney Docket No.: BGI-125CP

```
TCCCGCAACGAGCTCCCTGCCATGGGTTATACCTCTGTGTATCCGCTGGCGATGATCGCAAAGATCCTG
GCCGCCCAAACGTTGTTGTTCCTACTTATC
```

RXC01749 - 3'-Region
```
TAGCATTGACCCCTTAAGCGCAG
```

RXC01971 - 5'-Region
```
AGGTCTTGTTTATTTCGGCTACTGATTCAGTAGCTGCGCTCCGATAGGATTCTTAGTTTTCAGTTCAGT
ATCTTTGAGCCACGGCTAGAATGTGAATCCT
```

RXC01971 - coding Region
```
ATGTCTAAGAAGAAGCCTCGCCCCATTCCGGTTCCTGCCCAATTTATCCCTGGTCTCATTGATGCGCAT
ACACATTTGGCATCGTGTGGAGGAGATCTTGCAGGGTTGGTGGAAAGGGCCAAGGAGGCGGGCGTCGAA
AAGCTTTGTACCGTCGGTGATGGTTTGGCTGAGGCCGAGCTTGCGCTGGAGGCCGCGCAACAGTTTGGC
AATGTGTTTGCTGCGTGTGCGATTCATCCGACGAAGGCTGATCAGTTGGATGGGGCTGCGCGTGCGCGG
CTGACGCAGATGGCGGCGGATCCGAATTGTGTGGCCATTGGTGAGACTGGTTTGGATTCGTATTGGATC
AAGCACGATCCAGAGGACACGGCGGCGTTGGATGTGCAAGAGGAGGCGCTGCGCTGGCATATTGATTTG
GCAATTAGTGCGGATAAGCCGTTGATGATTCACAATCGTGAGGCGGATGCTGATTTGATGCGAGTGTTG
GCGGATGCTCCACCTCCAAAAGATACGATTCTGCATTGTTTTCTTCGCCGTTGGACGTGGCGAAGGAA
GCGTTGGATCGTGGATATGTGTTGAGTTTTGCGGGCAATGTGACGTTTAAGCGTAATGAGGAGTTGCGG
GAGGCTGCTCGTATTGCGCCGATTTCCCAGATTTTGATTGAAACCGATGCGCCGTATATGACGCCGGAG
CCGTTTCGGGGGAGTAGGAATGAGCCGTCGTTGATTGGTCATACGGCGCTATGCATTGCGGAGGTTCGG
GGGATGGCTGTGGAGGATGTTGCGGCGGCTTTGAATGAGAATTTTGATCGCGTTTATGGGGTCACAAAT
CTA
```

RXC01971 - 3'-Region
```
TAACGTGAGGTAGCTCACAGTCA
```

RXC02697 - 5'-Region
```
TTTGGCTCACCTCGATGATGTAGACATCCCCGATGAGGTGCGCGCACAGTTGCGGGCACTGGCTATCCG
CTCAACCGAACGTCGGATGTAGTAGACGCGT
```

RXC02697 - coding Region
```
ATGACACTTTTTCAACGTTTAACCAACCCTGTAGTGCTCGGCGGCCTAGCAGGTGTTTTGCTTCTGCTC
GGCTCTTTCGGTGGCGGTGCCATTCGGTACCGTGGCGGAGTGCTCGATGCGTTGGGGCTTAACTTCCTT
GCTTTTGGCCACGCGCAGGGTATTTCCAATACCGTGTTGTGGGTTGGGCAGCTGCTGCTGATTGGCGCG
TGGGTTCACCTTGGACGTCGGTTGTTCAAGAAAAAAGTCGCTGATGACACCGCAGACGCTGCTGACTTA
GGTCTTGTAAAGCGCACGTTGTATGCCATGGTGGTGCCCCTCATTTTTGCGGCACCAATGATGTCGCGT
GATGTTTATTCCTATCTCATGCAGGGCGCGATGCTGCGTGATGGCTTCGATCCCTACACTGAGGGCGCT
GCGGTAAACCCTGGCCCCATGTTGCTTGAGGTCTCTCATGATTGGCGCAACACCACGACGCCGTATGGT
CCACTACACCTGTGGATTGGAGACATGATCACCACGGTTGTGGGCGATAATGTCACCTTGGGCGTCGTC
GCTTACAAGATCTTGTCGATCATTGGCCTTGCTGTGACAGGCTGGAGCATTGTCCGCATTGCACAACAT
TTTGGAGCCAACCCAGCAATTGCATTGTGGATTGGTGTGGCCAATCCTGTGATGATCATCCACATGATC
GGCGGCATGCACAATGAATCCCTCATGGTGGGATTGGTCAGCGTCGGCTTGTTGCTAGCACTGAAGAAG
CGTTTCGTGGCAGGTGTGGCACTCATTGCAGTGGCTGTGTCGCTGAAAGCTACAGCGGCGATTGCACTT
CCTTTTGTGGTGTGGATCGGCATGCATCATTTCGCAGGATTCTTAGCCACCAAAAAGGGCAAAGACTCC
CCTACCCTTAAGCAACAGGTCCCCGCGTTCTTTGCCACTGGAGCTGCAGGTGTTGCTGTCACTGGTGTT
GTTGTCAGTGCGATCACTTGGGCGTCTGGCGCTTCGTGGGGCTGGATCAGTGAGATCAGTGGCAACAGC
AAGGTAATCAACCCGCTGGCTTTCCCTTCTTTGGTGGCCAGTGTGATCACCATGGTGGCTGAAGTGTTC
GTTGACGATTTCGACTACAACGCAGTGGTTAATGTTGTGCGCTCAATCTCCATGCTGATCATGCTTGGC
GGGTTGGTCGTATGTTGGTGGCTGTTCCGCCAGAACGAACGCAGGGCGGTCACTGGTACAGCAGCGGCT
TATGCCGTGGCTTTTGTGTTCAATTCTGTGACCTTGCCGTGGTACTACGCCAGCTTGATCTCTTTGCTC
GGCACATTTAAACCACCGATGTGGTTGATTCGCTTCGCAGCGGGTGCTTCGGTGTTTATCGCGCTGATG
TTTACCGGAAGTGGAAACCACCAGCTGTACAACATCGTTACGGTGATCATCGCAGCAATTATCGCGTGG
CTTGCCACCGTGGTGATCTTTGATGACACTGACCCTGCAACAACGGCCACGGAGAAACCCTCCCCGCAT
ACCGTTTCC
```

RXC02697 - 3'-Region
```
TAGTTGCATAAGGTAAACCGCCA
```

RXS00148 - 5'-Region

Appendix A, page 135

CTTTGAGGGCAGCGCGCATGCGCCCGATGGTTATTTGAACATGACAATTGATGCCGCGGCGACGCTGGC
TGACCTGCTAGATGCTTTGGGAGCTTAAATC

RXS00148 - coding Region
ATGACGTCGATCCCTAATTTTTCAGACATCCCATTGACTGCTGAGACACGTGCATCGGAGTCACACAAC
GTTGACGCCGGCAAGGTGTGGAACACTCCCGAAGGCATTGATGTCAAGCGCGTATTCACGCAGGCTGAC
CGCGACGAGGCGCAAGCGGCGGGACATCCGGTGGATTCTTTGCCAGGTCAAAAGCCATTTATGCGCGGG
CCGTACCCAACTATGTACACCAATCAGCCGTGGACGATTCGCCAGTACGCAGGCTTTTCAACCGCCGCG
GAATCCAATGCGTTTTATCGGAGGAACCTTGCTGCGGGTCAAAAAGGTTTGTCGGTTGCGTTCGATCTA
GCGACCCACCGCGGTTATGACTCGGATAATGAGCGCGTGGTCGGCGATGTGGGTATGGCCGGCGTGGCG
ATTGATTCGATTTTGGATATGCGTCAGCTGTTTGATGGCATTGATTTGTCCAGCGTGTCGGTGTCGATG
ACCATGAATGGCGCTGTGCTGCCGATTCTTGCGTTCTATATCGTGGCGGCTGAGGAACAAGGTGTGGGT
CCGGAGCAGCTTGCGGGCACGATCCAGAATGACATCTTGAAAGAATTTATGGTGCGCAACACCTATATT
TATCCGCCGAAGCCGTCGATGCGCATCATTTCCAACATCTTTGAGTACACCTCCTTGAAGATGCCACGT
TTTAACTCCATTTCGATTTCTGGCTATCACATCCAGGAAGCGGGAGCGACTGCCGATTTGGAGCTGGCC
TACACTCTGGCGGATGGTATTGAATACATCCGTGCAGGTAAAGAGGTAGGCCTTGACGTGGATAAGTTC
GCGCCTCGTCTGTCCTTCTTCTGGGGTATTTCTATGTACACCTTCATGGAGATCGCAAAGCTGCCTGCG
GGACGACTGCTGTGGAGCGAGTTGGTGGCAAAATTCGATCCGAAAAACGCCAAGTCCCAGTCGCTGCGC
ACGCACTCGCAGACCTCTGGTTGGTCGTTGACCGCGCAGGATGTGTACAACAACGTCGCCCGCACCGCG
ATTGAGGCGATGGCTGCAACCCAGGGCCACACCCAGTCGCTGCACACCAATGCACTTGATGAGGCGTTG
GCGCTGCCCACCGATTTCTCTGCTCGTATCGCCCGAAACACCCAGCTGTTGCTGCAGCAGGAATCTGGC
ACGGTGCGTCCAGTTGATCCATGGGCGGGCTCCTATTACGTGGAGTGGTTGACCAATGAGCTGGCTAAC
CGCGCGCGCAAGCACATCGATGAGGTGGAGGAAGCCGGCGGAATGGCGCAGGCCACCGCGCAGGGAATT
CCTAAGCTGCGCATTGAGGAATCAGCGGCACGCACCCAGGCTCGCATTGATTCCGGCCGCCAGGCGCTG
ATCGGCGTGAATCGCTACGTGGCGGAAGAAGATGAGGAAATTGAAGTCCTCAAGGTTGACAACACCAAG
GTTCGCGCAGAACAGTTGGCTAAACTCGCGCAACTGAAAGCAGAGCGCAACGATGCGGAAGTCAAGGCT
GCGCTGGATGCGTTGACAGCTGCTGCCCGCAACGAGCATAAAGAGCCAGGGGATTTGGATCAGAACCTG
CTCAAACTTGCCGTCGATGCTGCGCGCGCAAAAGCTACCATTGGAGAGATCTCCGATGCTTTGGAAGTT
GTCTTTGGCCGCCACGAAGCAGAAATCAGGACGCTGTCTGGCGTGTACAAGGATGAGGTTGGAAAGGAA
GGCACAGTGAGCAACGTCGAACGCGCGATCGCCCTGGCTGCGCCTTTGAGGCTGAGGAAGGCCGGCCGC
CCACGTATCTTTATTGCCAAGATGGGCCAGGATGGACATGACCGTGGACAGAAGGTTGTCGCGTCTGCC
TATGCTGACCTGGGCATGGACGTGGATGTTGGACCGCTGTTTCAAACTCCAGCCGAAGCTGCCCGCGCC
GCCGTGGACGCCGATGTTCACGTGGTGGGTATGTCTTCGCTGGCAGCAGGCCACCTCACCTTGCTGCCC
GAGCTGAAGAAAGAACTTGCAGCTCTTGGCCGCGATGACATTCTGGTCACCGTGGGCGGCGTCATTCCG
CCGGGCGATTTCCAGGATCTCTACGATATGGGTGCCGCCGCGATTTACCCTTCAGGAACCGTCATCGCG
GAGTCGGCGATCGATCTGATCACCCGACTCGCCGCACACCTGGGCTTTGACCTGGATGTGGATGTGAAT
GAA RXS00148 - 3'-Region
TGATCACGGTTTCCTAGAAGACA RXS00149 - 5'-Region
TTTTCGTAGGTAAACACAGGTGAAGGCTTTACAAGCTTGTGAACTCCCTACACAAAAGCAATCCAATAG
CTATCCATAAGCAAGAGAAAGTAAGTCTACG RXS00149 - coding Region
TTGACTGATCTCACAAAGACTGCGGTGCCCGAGGAACTTTCAGAGAACCTCGAAACTTGGTACAAGGCT
GTGGCCGGTGTTTTCGCGCGCACACAGAAAAAAGACATCGGCGACATTGCCGTAGATGTGTGGAAGAAA
CTCATCGTCACTACACCGGATGGTGTTGATATCAATCCGCTGTACACCAGAGCAGATAGTCCCAGAGG
AAATTCACTGAGGTTCCTGGTGAGTTTCCCTTCACTAGGGGAACCACTGTTGATGGTGAACGCGTTGGT
TGGGGTGTTACTGAGACTTTCGGACATGACAGCCCGAAGAATATCAACGCTGCGGTGCTGAATGCTCTG
AATTCTGGCACCACCACATTGGGTTTTGAGTTCTCTGAGGAATTCACGGCAGCTGATCTTAAAGTTGCT
CTCGAAGGCGTGTATCTCAACATGGCTCCGTTGCTGATTCATGCGGGTGGATCCACGTCAGAGGTTGCA
GCGGCGTTGTATACGTTGGCGGAGGAAGCCGGAACGTTTTTGCTGCGTTGACCTTGGGTTCTCGTCCT
TTGACGGCGCAGGTTGATGGTTCGCACAGTGACACCATTGAAGAAGCAGTTCAGTTGGCAGTGAATGCT
TCCAAGCGTGCGAATGTGCGCGCTATCTTGGTGGATGGTTCCAGTTTTTCCAACCAGGGCGCGTCGGAT
GCTCAAGAAATTGGTCTAAGTATCGCCGCCGGTGTGGATTATGTCCGTCGCTTGGTCGATGCAGGCCTT
TCCACGGAAGCTGCACTTAAGCAGGTGGCGTTCCGTTTTGCGGTCACCGATGAGCAGTTCGCGCAGATT
TCTAAGCTGCGTGTGGCTCGACGTCTGTGGGCCAGGGTGTGTGAGGTGCTTGGTTTTCCAGAGCTGGCC
GTAGCACCACAGCATGCGGTGACTGCACGAGCGATGTTAGCCAGCGTGATCCGTGGGTGAATATGCTG
CGCAGTACTGTTGCAGCTTTCGCTGCAGGCGTCGGTGGAGCAACCGATGTGGAGGTTCGTACTTTTGAT Attorney Docket No.: BGI-125CP GATGCGATCCCAGATGGAGTTCCTGGAGTGTCGAGGAATTTCGCTCACCGCATCGCGCGCAATACTAAT
TTGTTGTTGCTAGAAGAGTCACATCTTGGTCACGTGGTTGATCCTGCTGGTGGATCATATTTCGTGGAG
AGCTTCACCGATGATCTAGCGGAGAAGGCGTGGGCTGTGTTCAGTGGCATCGAAGCTGAGGGCGGATAC
AGTGCAGCTTGTGCATCCGGCACGGTGACTGCCATGCTTGATCAGACGTGGGAGCAGACTCGCGCTGAT
GTGGCGTCGAGAAAGAAGAAGCTCACTGGAATTAATGAGTTCCCGAACTTGGCGGAGTCTCCGCTGCCA
GCTGATCGTCGGGTAGAACCTGCAGGTGTGCGTCGATGGGCAGCGGATTTTGAAGCGCTGCGCAATCGT
TCGGATGCTTTCTTGGAAAAGAACGGCGCGAGGCCACAGATCACGATGATTCCTCTGGGACCGTTGTCC
AAGCACAATATTCGCACTGGTTTTACTTCCAACCTGTTGGCTTCCGGTGGCATTGAAGCAATCAACCCG
GGTCAACTTGTTCCCGGCACTGACGCTTTTGCAGAAGCTGCACAGGCCGCAGGCATTGTAGTGGTGTGT
GGAACGGACCAAGAGTATGCCGAAACGGGGGAGGGAGCCGTCGAAAAGCTCCGCGAAGCGGGCGTTGAG
CGCATCCTGCTTGCTGGCGCGCCGAAGAGCTTTGAGGGCAGCGCGCATGCGCCCGATGGTTATTTGAAC
ATGACAATTGATGCCGCGGCGACGCTGGCTGACCTGCTAGATGCTTTGGGAGCT RXS00149 - 3'-Region
TAAATCATGACGTCGATCCCTAA RXS00948 - 5'-Region
ACACCCTCCAAATGATCTCGTAAAACAGTATTGAATTTAGGTACGACTCTAATCGTACCTTGCCCTCAA
GCCAAGCTAGTTGTACGATCAAACTCGTTGT RXS00948 - coding Region
ATGGCAAACGTCGTACTAGTCGATCGAATGGAGCCTTTGGTGTCCAAGCTGTTTACCCCAATTCAAATC
CGCGACATCACCATCCCCAACCGCGTGTGGATGTCACCGATGTGCACCTACTCTGCAGCCACCGGTTCA
GGTCTTCCCACCGATTTTCACCAGGCTCATTACGCAGCTCGCGCAGCAGGTGGTGTCGGATTAGTCATG
GTTGAAGCAACTGGAGTGAACCCCGTAGCTCCCCATCTCCCCAGTCGACCTTGGACTTTGGAGCCATGAC
CAAATTGAACCATTCTCCCGAGTGACAGCAGCTATTCGCGCCGGTGGGGCAGTACCGGCCGTTCAATTA
GCCCATGCTGGCCGCAAGGCATCCACCGATGCTCCGTGGAATGGTGGCGGATATGTTGGACCAGAAACC
AATGGATGGGAGACTGTCGGCCCCAGCCCTCTGGCATTCCCAGGTTTGCCTGCTCCGCGCGAGCTGACG
GTTTCAGAAATCCAAGAGGTTGTGCAGCAGTTCGCTGGCGCCGCCGTTCGTGCCGATCAGGCTGGTTTT
GATGTCGTGGAAATTCACGCAGCACACGGCTACCTTTTGCATAACTTCCTTTCTCCGATCTCCAACAAG
CGCACCGATTCATACGGCGGATCTTTAGAAAACCGCGCTCGCATCGTGCTCGAAGTCATTGATGCAATC
CGCGCAGTGTGGCCAGAGGAAAAGCCTGTATTCATGCGCATTTCCACCACCGACTGGGTGGAGGAAAAC
CCACAGGATGATCGCGAGTCCTGGACGCTGAGCCAAAGCAGGCAGCTGGCTTTGTGGGCATCCGAGCAC
GGAGTTGATTTGATCGATGCCTCTTCTGGTGGCCTCGACATCGTCCCCATTCCGCATGACCGCGATTAC
CAAACCGCGAAGGCCGCAGATCTTCACGCAAGTACCGGAGTGACAGTCGCTGCTGTGGGGCGCATTGAT
GACGCCCAAACTGCGCACAATTTGGTTGATTCTGGCGATGTCAATGCAGTTTTCCTCGGCCGTCCACTG
CTCAAGGATCCTTCCTGGGCAAACCAAGCAGCCCTCGCACTAGGTGCGGAACCCAGGTATGTTCACCAA
TACGACTACGTACTT RXS00948 - 3'-Region
TAAAGGAGAGTTGACATGAAGGT RXS01166 - 5'-Region
ACCGTACCCACAGACACACCAGAATTAACAGAAACAGACTGAAAAACAACATCGCTCGACATGCGCGTA
ATCCTAACCCGCGCACACTAATGTGGCCGAT RXS01166 - coding Region
ATGGGCTACACCAACCTCAACGACACACGGGTCTTGCGCGCCGGGTCATGTGATGCCTGGTGGCGCACG
ATGTCTCCGCTAGTGCAGCAGGGAAGTGAGGCAGTCTTTCGGCGCATCATGGGTCTCTCGCGGCGTCCT
GATCGGAAACCTGGCTTTGACGATGTCCCACATTTCGGCGCAGCTGTTCGAGTTCCCGGTCTAAAACAC
GGCACGTTGGTCAATGCTGCACCCTTGAAAGTTTTGGGCGCACGGGCGAGCCCAACCCCGCGAGTTCG
TACCGTTTTGAATACATCACCGGTGATTCCGCAGGTCGAGCCATCACTGCGACCGGCGCTGTCCTCTTT
TCCACACGCCCCTGGACAACCGGCCCGCGTCCCGCGATCGCCATGGCTCCATCCACCCAAGGCGTCGCA
CAGCACTGCGATCCCTCCCACACCTGCGCCATCGGACTCAACGCATTCTATGACAAACCCTTCGACGCA
ATCATTGCTTACGAACTCCCCGTCATCCTCTGGTTTCTAGCTCACGGACTTGACGTTGTGTTCATCGAT
TACCCCCGCGACCCCGCAACCGGCGTCCAATACTATTGCGATTCCATCGCTGCAGCTAAATCGCTTCTC
GACGCCGTCCTCGCCTCCAGACAACTCGGCCTTTCACCGGAAGCACCGCTTGGCCTGTGGGGATTCTCC
CAAGGAGGCGGCGCCACTGGCTGGGCTGCACAATTGCAGGATTACGCACCTGATGTCCGCCCAAAGGCA
GCGGTCGTGGGCGCTCCACCAGTGGATCTCTTCCGCGTCTTGGACACTGTCGACGGCGGATTGCTCACC
GGAGTGATTGCCTACGCCATCGCGGGACTTGCAGTGAACTCTTCAGAGATGTTTGAGGAAATCATGTCG
GTGTTAAATGAACGCGGAGTCAGTGATGTGCTGAAAAATATCACCAGCTGCGCGGGAGGTTCCTTGTTG Appendix A, page 137

Attorney Docket No.: BGI-125CP

GCCAGTGGCTACTCGTCTTCCCGCGGGTGGACACATCAGGGCACGCCGCTGGCAGACATTCTGGACGAT
CTGCCACTTGTTGTCGCTGAGTTTGGGAAGCAAAAGCTGGGTCGTGTGGCGCCAGAAATCCCAGTGCTG
TTGTGGGGCTCTAAAAATGATGATGTCATTCCCATTGATCCCATTAGGGAATTGCGTGATAGCTGGGCG
GACAAGGGTACGCCATTGACCTGGCATGAATCCCAAGCGCCGCGTGTGCCAGGACGCACAGGTCTCAAC
CATTTCGGGCCCTATTTTAGAAACCTGGAAAAGTACTCGGGATGGCTCATAGATCATCTTGTC

RXS01166 - 3'-Region
TGAGTGCCGTTTTAAAGGCTCGG

RXS01746 - 5'-Region
AAACCGCCACTCCCCTTTCACTGGGGAGTGGCGGTTTTGTCGTTTCATGCATGCAGTGTGTGACTTATC
AACCTTGTTAGGGCTAGGGTGGATATCTATC RXS01746 - coding Region
ATGACTGCACCAAGAGATCCTTTTTTCCCCGCAGATCTTTCTATCCGCGCGTCTGCAGAGCCCATTGAA
ATTCAGCGGTTGGGTTTGATCGATTATCAAGAGGCCTGGGATTATCAAGCAGAGCTTGCTACCCGTAGG
GCTAATGATGAAATCCCTGATCAGCTGCTTATTTTGGAGCACCCGTCGGTGTATACCGCAGGTAAGCGC
ACCCAGCCGGAAGATCTTCCCACCAACGGACTGCCGGTGATCAATGCTGATCGTGGTGGTCGCATCACG
TGGCATGGTCCTGGCCAATTGGTGATCTATCCGATCATCAAATTAGCCGATCCGATCGATGTGGTTGAT
TACGTAAGACGCCTCGAGGAAGCGCTCATCCAAGTTGTCGGCGATATGGGTGTTGCCGGCGCTGGGCGC
ATTGATGGGCGTTCGGGTGTGTGGGTGCCAGCTCATGATGGTTGGGTGGACAGCAAGGTTGCGGCCATC
GGCATTCGAATAACTCGTGGTGTTGCAATGCACGGTGTGGCCATCAACTGCAACAACACGTTGGATTTC
TATGAGCACATCATTCCGTGTGGCATTGCTGATGCAGGCTTGAGCACACTCTCGAGGGAACTGAAAAGG
GACGTTTCAGTTGAGGAATTAGTCGAGCCATCGATCCGCGCATTGGATGATGCTTTGGCTGGTCGGCTG
GTTGTTTCTGATCATTCTTTCGGCAGCGCGCCCGACCCAACTAAGAATCTCCCTAAACGGGGG RXS01746 - 3'-Region
TAGTACGAGGAATTTTGTCGGTG RXS01747 - 5'-Region
CGAAGTAGAGCCGATTGCAGAATCGGCGGAATGAGACGTCGAAAAGCGTTTAAGCTTTCCCTAAAAATA
TCACTAACTCGAAAGATGTAAGGTTGCATTT RXS01747 - coding Region
GTGACTATCGCACCTGAAGGACGACGACTGCTACGCGTCGAAGCTCGAAACTCAGAAACCCCGATTGAG
ACGAAGCCTCGATGGATTAGAAACCAGGTCAAAAACGGACCTGAGTATCAGGATATGAAGGAACGTGTC
GCTGGCGCATCACTACACACTGTGTGTCAGGAGGCTGGCTGTCCTAATATCCATGAGTGTTGGGAATCC
CGTGAGGCAACCTTCCTCATTGGTGGCGCCAACTGCTCTCGCCGCTGTGATTTCTGCATGATCAACTCG
GCTCGCCCTGAGCCACTCGACCGCGGTGAGCCACTGCGTGTCGCTGAGTCTGTTCGTGAGATGCAGCTG
AATTACTCCACCATCACCGGTGTTACCCGTGATGATCTGATGATGAAGGCGCCATGGCTGTACTCAGAA
GTGGTTCGTAAGATCCACGAGCTGAACCCACACACCGGTGTGGAAAACCTGGTGCCTGATTTCTCCGGC
AAGAAGGATCTGCTGCAGGAAGTTTTTGAATCCCGCCCAGAGGTTTTCGCTCACAACGTGGAAACTGTG
CCACGTATTTTCAAGCGCATTCGCCCAGCATTCCGCTACGAGCGTTCACTTGATGTGATCCGTCAGGCT
CGCGATTTCGGTCTGGTGACCAAGTCCAACCTGATTTGGGCATGGGTGAAACCAAGGAAGAAATCACC
GAGGCGCTGCAGGATCTGCACGACGCTGGCTGTGACATCATCACCATCACCCAGTACCTGCGTCCTGGT
CCTTTGTTCCACCCCATCGAGCGTTGGGTGAAGCCTGAGGAGTTCCTCGAGCACGCTGATGCTGCAAAG
GAAATGGGCTTCGCTGCTGTTATGTCCGGCCCATTGGTTCGTTCCTCTTACCGTGCAGGCCGTCTGTAC
GCGCAGGCCATGGAGTTCCGTGGCGAGGAAATCCCAGCACACCTCGCGCACCTGAAGGATACTTCCGGA
GGATCCACCGCCCAGGAAGCATCTACACTTCTGGAGCGTTACGGTGCTTCCGAAGACACCCCAGTGGTG
TCCTTCAAC RXS01747 - 3'-Region
TAAGCCCGAAGTTTTTTAACCGC RXS01879 - 5'-Region
CTTTGCGGGCCGCTGATATTGATCCAACGCTTCGTGGCGAAAAGCTTGATGTCACTGACTATGTGCGCC
TAGCTGGGGTGTTGCAGCAAAAGGATGAGAA RXS01879 - coding Region
GTGAAAATTACCGCTAAGGCGTGGGCGAAAACCAACCTGCATTTAGGTGTGGGACCGGCTCACGACGAT
GGATTTCACGAGCTCATGACGGTGTTTCAAACCATTGATCTGTTTGACACCGTCACCTTAACCACCCTC Appendix A, page 138

```
GATGAGGAGTTGGTGGAGGAGGGAGCGTCGTCAAGCAATTATCTGTGACCGGTGCCCGTGGCGTGCCT
GAGGACGCCAGCAATCTTGCGTGGCGCGCTGTGGATGCGTTGGTTAAGCGGCGCGCGGAAAAGACGCCG
CTGTCTGCAGTTTCGCTGCATATTTCCAAGGGGATTCCGGTGGCTGGCGGCATGGCTGCGGCTCTGCG
GATGCGGCTGCGACACTGCGCGCAGTGGATGCCTGGATTGGGCCTTTCGGCGAGGACACATTGCTGGAG
GTTGCCGCGGAGCTCGGCTCAGATGTGCCGTTTTGCCTGCTTGGTGGCACCATGCGCGGTACCGGTCGC
GGCGAGCAGCTGGTAGATATGTTGACGCGCGGCAAGCTACATTGGGTGGTGGCCGCGATGGCGCATGGC
CTGTCCACGCCTGAGGTATTCAAAAAGCATGATGAGCTGAATCCGGAATCGCATATGGATATCAGCGAC
CTCAGCGCCGCACTTCTCACCGGCAACACCGCCGAGGTGGGGCAGTGGCTGCACAATGATCTGACCAGC
GCCGCACTCAGTTTGCGCCCTGAACTGCGCAGCGTCCTCCAAGAAGGCATCCGCTCCGGCGCGCATGCA
GGAATTGTCTCCGGCTCCGGCCCGACCACGGTATTCTTGTGCGAATCGGAGCACAAAGCGCAAGACGTT
AAAGAGGCGCTAATCGACGCCGGCCAGGTGTACGCTGCTTACACCGCCACCGGCCCTGCGGCCTCAACC
GCCGACCAGCGCGGCGCACACATTTTGACTGTTTCA

RXS01879 - 3'-Region
TAATAAAGACAAACTTAAGTATC

RXS02023 - 5'-Region
GATGTGGCAGCAATTTTGAAGCAGTACCTGAGCGAGTAACCGCATTCGGGGTTATCGTGGGACTTCCGA
AATGTAACTAGAGACTAGAGGAGGAAACACG RXS02023 - coding Region
ATGGCTCCTAAACAAACTCCCAGCCCAGAGAAGAATCGAAACCTGGTGGGACCAGTTCTGCAACGTCGG
CAGACAGAGGGTACTTTTGATCAACGCTTGCTAGAAATGCGCGCTGATCACAATTGGAAGCACGCCGAT
CCATGGCGTGTACTGCGTATTCAGTCTGAGTTTGTGGCGGGTTTTGATGCCCTCCACGAGATGCCAAAG
GCCGTAACCGTCTTTGGTTCCGCACGCATTAAAGAGGATCACCCGTACTACAAGGCGGGTGTAGAACTT
GGTGAAAAGCTCGTTGCAGCGGACTACGCAGTTGTCACCGGTGGCGGTCCAGGTCTGATGGAAGCCCCC
AATAAGGGGGCAAGCGAGGCCAATGGTTTATCAGTTGGTCTGGGCATTGAGTTGCCACATGAACAGCAT
CTGAACCCTTATGTGGATTTGGGTCTGAACTTCCGGTACTTCTTCGCACGCAAGACCATGTTCCTGAAA
TACTCCCAGGCTTTTGTGTGTCTGCCTGGTGGTTTCGGCACGCTCGATGAGCTTTTCGAGGTCCTCTGC
ATGGTACAAACCGGCAAGGTACCCAACTTTCCCATCGTCGTGATCGGCACTGAGTTCTGGGCAGGTTTG
GTGGATTGGATCCGTCACCGCCTGGTAGAGGAAGGCATGATCGATGAGAAGGATGTTGACCGGATGTTG
GTCACTGATGACCTGGATCAGGCCGTCAAATTCATCGTCGATGCACACGCTGGATTGGACGTAGCGCGT
CTCCACAAT RXS02023 - 3'-Region
TAAGCAGTGGCTACATTAGGTGT RXS02106 - 5'-Region
GGTCGCCGCTTTTCGACGCCCGCCTGCGGCGGGATGACTGTGATGGAGGGGCGCGTCGACAAGCAAAAT
CTCTTTAGCAAATTCGGTTACTGTGGGGCGC RXS02106 - coding Region
ATGAATAACCATTTTGAGCTCAAAGTACCTGGTGGAAAGCTTGTCGTCGTTGATGTGACCACCGATCTG
GATTCCATTGCTGACGTGAAGATTTCCGGCGATTTCTTCCTCGAACCCGATGAGGCATTCTTCGCCCTT
GGCCGGGCGCTGCAGGGGCGTCGGTGGGTGATAACACTGATCGTTTGCAGGCAAAGTTGGATGCAGCG
TTGGCGGAATATGATGACGTTGAGCTACACGGCTTTAGCACTGCGGATATTGCTTTAGCTGTGCGTCGG
GCAGTCACCGGCGCGCAAGATTTCACCGATTATGAATGGGAAATCCTGCACCCAGGGGTGCTTCCTACC
CCACTTAACGTTGCGTTGGATGAGCTCCTTTTGGACCAAGTTGCCAGTGGTCAGCGTGGCCCGACGATG
CGCATTTGGGATTGGATGATCGCGCCACAGTGATCGGTAGTTTCCAGTCATATGTCAATGAAATCAAC
CAAGAAGGCGTTAATGAACATGGTGTGACCGTGGTACGACGCATGTCTGGTGGCGGTGCAATGTTTATG
GAGGGCGGCAACTGCATCACCTATTCCCTGTATGCACCGGAATCTCTCGTTGCTGGTTTGAGCTATGAG
CAGTCCTATGAATATTTGGATCGTTGGGTGATTGCTGCGCTGAAGACACACGATGTTGACGCTTGGTAC
GTGCCTATCAATGACATCACCTCCACCGGCGGAAAAATCGGTGGCGCTGCACAGAAACGTCGCAGTGGC
GCAGTCCTCCACCACGTGACCATGTCCTATGACATCGATGCGGACATGATGACCCAGGTGTTGCGCATT
GGAAAGGTGAAGATTTCCGACAAGGGTCTTCGCAGCGCAAAGAAGCGCGTTGATCCTCTGCGCCGCCAA
ACAGGTGCATCACGTGAGCAAATCATCGACACCCTAAAGTCCACATTCAGTGCTAGGTACGGCGCGCAA
GAAGTAGAGCTCAGCGATGAAGATTTCGCGGCAGGCCACGACCTAGTAAAAACCAAATACGCCACCGAG
GAGTGGACTAAGCGAGTTCAA RXS02106 - 3'-Region
TAGTTTCTATGGATCTGCACAAG
```

Attorney Docket No.: BGI-125CP

RXS02228 - 5'-Region
ACAGAAGCGTCAACTGCTCAACTTCTCGACAGCGACGACACACACGGCGTGGGACGCTACGTTGCTCGC
TGGACTTTTTAACTTAAGGGAGATCTAGATC RXS02228 - coding Region
GTGGTAACACCGATCGCAGTGGTTGGACCCACTGCATCTGGAAAATCAGCTTTGGGAATTGCTCTAGCC
CACAAGCTTGACGGTGAAGTAGTCAATGTGGATTCCATGCAGCTGTACAAAGGCATGGACATCGGCACG
GCAAAGCTGACTGTCGAAGAACGCGAAGGCATTGCGCATCATCAGCTCGATGTCTGGGACGTTACCGAA
ACTGCGTCAGTGGCGAGGTTTCAATCCGACGCCGTTGCCGATGTGGAAGATATTATGTCCCGTGGCAAA
ACCCCCATCTTGGTTGGCGGCTCCATGTTGTACGTCCAATCTTTGGTCGATGATTGGCAATTCCCACCT
ACCGACAGCGCTGTTCGCGCACGCTTTGAGGCCCGCTTGGCAGACATCGGTGTCGAAGCACTACACGCT
GAACTTACTCAGCTTGACCCAGAAGCAGCAGCCGTCATCGAAAGCAATGATCCCCGACGCACCGTCCGA
GCATTAGAAGTCATTGAACTAACCGGCCAGCCCTTCCAAGCAAGCCAACCGCCCAAAGACGCGCCACCT
CGCTGGGGAACTCGAATCATTGGCCTGAAAACCACTCCAGAATGGCTAAATCCACGCATCGAGCAGCGC
ACCGCCAGGATGTTTGAACAAGGCTTTGTCGCCGAAGTGGAACACCTTGTGCAGCAAGGACTCATCGCT
GACTCCACCGCGGGACGAGCAATCGGCTACTCCCAAGTACTGGCAGCCATGGCAGGGGAGATGACCTGG
GAAGACGCCTTCGAACGCACGGTCACCGGAACCAGACGCTATGTCAGGCGCCAACGCAGCTGGTTCAAC
AGAGACCACCGCGTGTCCTGGGTCGACGCCTCTGGCGATCCCACCGCACAAGCCTTGGAGATTTTGGGT
CTACAA RXS02228 - 3'-Region
TAGCGAGGGTGAATTTGACCATC RXS03212 - coding Region
GCCTCACTTAACTGGTCAGTCATCGTTCCAGCCCTAGTCATTGTCCTAGCGACAGTGGTGTGGGGTATC
GGATTCAAAGATAGCTTTACCAACTTTGCTAGTTCTGCGTTGTCAGCAGTAGTTGACAATCTCGGCTGG
GCCTTCATTTTGTTTGGCACAGTCTTTGTATTTTTTATCGTTGTTATCGCCGCTAGTAAATTCGGCACG
ATTCGCTTAGGCCGCATTGATGAAGCACCAGAGTTTCGCACGGTGTCATGGATTTCCATGATGTTTGCT
GCAGGTATGGGTATTGGTTTGATGTTCTACGGAACCACAGAACCTTTAACCTTCTACCGCAATGGTGTA
CCTGGACATGATGAACACAATGTTGGCGTTGCTATGTCCACGACAATGTTCCACTGGACCTTGCATCCA
TGGGCTATCTACGCAATTGTGGGCCTAGCCATTGCCTATTCGACCTTCCGAGTGGGCCGTAAACAGCTT
CTAAGCTCTGCATTCGTGCCACTCATTGGTGAAAAAGGTGCAGAAGGATGGTTGGGCAAGCTCATCGAC
ATCCTGGCGATTATCGCCACCGTATTCGGCACGGCATGTTCCCTTGGCCTTGGTGCCCTGCAGATTGGT
GCAGGCCTGTCCGCAGCAAACATCATTGAAGATCCAAGCGATTGGACCATCGTTGGCATTGTTTCTGTT
TTGACCCTGGCATTTATCTTCTCCGCTATTTCTGGTGTGGGCAAGGGAATCCAGTACCTCTCCAACGCC
AACATGGTTCTGGCAGCTCTGCTCGCGATTTTCGTGTTCGTTGTCGGACCAACCGTGTCGATTTTGAAC
CTGCTGCCAGGTTCTATTGGCAATACCTGTCCAACTTCTTTCAAATGGCAGGCCGCACTGCCATGAGT
GCCGACGGCACAGCAGGTGAGTGGCTAGGTAGCTGGACCATCTTCTACTGGGCATGGTGGATCTCTTGG
TCACCATTCGTAGGAATGTTCTTGGCACGTATTTCCCGTGGCCGCTCCATCCGTGAGTTCATCCTGGGC
GTGTTGCTCGTCCCAGCAGGTGTGTCCACCGTATGGTTCTCCATTTTTGGTGGCACTGCGATTGTCTTC
GAACAAAATGGGGAATCCATTTGGGGTGATGGTGCAGCAGAAGAGCAGCTTTTTGGATTGCTTCATGCA
CTTCCAGGTGGGCAAATCATGGGCATCATCGCCATGATTTTGCTGGGTACTTTCTTCATTACCTCTGCT
GACTCTGCTTCCACCGTCATGGGCACCATGAGTCAGCACGGCCAGCTGGAAGCCAACAAGTGGGTGACA
GCTGCCTGGGGTGTTGCTACCGCAGCTATTGGACTAACGCTATTGCTTTCTGGTGGTGACAATGCCTTG
AGCAACTTGCAAAACGTCACCATCGTGGCTGCAACACCATTCTTGTTTGTGGTTATTGGATTGATGTTT
GCG RXS03220 - coding Region
ATGGGCTTAAGGGAAATTTTGTCCAGCAAGTGGCTTGTGCGCATCCTCCTGGTAGGTATCGGATTGGGT
GTCGCACAGCAGCTGACCGGCATCAACTCCATCATGTACTACGGCCAGGTTGTTCTCATTGAGGCTGGT
TTCTCCGAGAATGCAGCTCTGATCGCCAACGTGGCGCCAGGAGTGATCGCAGTTGTCGGTGCATTCATC
GCACTGTGGATGATGGATGGTATCAACCGCGTACCACCCTCATTACCGGTTATTCTCTCACCACCATT
AGCCACGTATTGATCGGTATCGCATCCGTAGCATTCCAGTCGGCGATCCTCTTCGCCCCTACGTTATC
TTGACTCTGGTTGTGGTCTTCGTGGGATCCATGCAGACCTTCCTCAACGTAGCTACCTGGGTTATGCTC
TCTGAGCTCTTCCCGCTGGCAATGCGCGGTTTCGCAATCGGTATCTCAGTGTTCTTCCTCTGGATCGCA
AACGCGTTCCTCGGATTGTTCTTCCCAACCATCATGGAAGCAGTAGGACTAACCGGAACCTTCTTCATG
TTCGCCCGGAATCGGTGTGGTTGCCTTGATCTTCATCTACACCCAGGTTCCTGAAACTCGTGGACGTACC
TTGGAGGAGATTGATGAGGATGTTACTTCCGGTGTCATTTTCAACAAGGACATCCGAAAAGGAAAGGTG
CAC Appendix A, page 140

RXS03220 - 3'-Region
TAAAAACCCAGACACTGCATAGATAACACG

Attorney Docket No.: BGI-125CP

APPENDIX B: AMINO ACID SEQUENCES

```
> RXA00051  (1-1404, translated) 468 residues
MNASPAPTRS FKGLRARHIH FIALGSAIGT GLFYGSAGAI QAAGPSVLLV YLLGGAVVYF
MLRALGEMAV HHPVRGSFAV YTRAHLGGWA GYITGWMFAF EMLIVCLADL TAIGIYMNFW
FPGTPQWTWV VATLLIVGGA NLASVRWFGE LEFIFTIIKV TAVVAMIVGG AAILAFGLGA
NAEVAGVSNL WEHGGFFPNG VEGMIAAFIL VLFAFGGTEI IGVAGSEAED PEKSIPKAVN
TVPVRILLFY VGAILVILAL NPWPSITGEE SPFVQIFDTL GVNWAAGLLN AVVITAALSA
INADLFGAGR VLTGLAKENL APKAMGKIAK NGVPVMTTTI MIIVLIVGVI LNAVLPERVF
EIVASLATFA TVYVWLMILL AQVGSRRNMP ADEVKSLKFP VPFYPFGQYF AILFIAFTFG
IMVWYDNYHL PLAVGVGFLV LMTILYYATG RPKAIAPIDY EELDPRRD > RXA00091  (1-753, translated) 251 residues
VITLTNVRKE YSSDVAIGPV NLEIPAGGIT ALVGPNGAGK STLLTMIGRL LGIDEGNITV
ASYDVTSTAS KDLAKIISIL RQENHFVTKL TVRQLVGFGR FPYSKGRLTE EDEGIISRYI
DFFNLTELED RYLDQLSGGQ RQRAYVAMVL CQETDYVLLD EPLNNLDIAH SVEMMKHLEN
AAAQFGRTII VVLHDINFAA RYADYIAVVK HGMIEKEGTP EQIMKNEILS EIFNTEIEVI
EGPHGKIACY H > RXA00092  (1-204, translated) 68 residues
IARALIGPRK ILLADEPTGA LDTSTGDAVL RVLRQRIDSG AAGLLVTHEP RFAAWADRTI
MLRDGEIQ > RXA00104  (1-756, translated) 252 residues
MTAQIDDSIL THRLAQGTGE ILKGVRNVGV LRGRNLGDAG DELAQSWIAR VLEQHRPNDG
FLSEEAADNP DRLSKDRVWI IDPLDGTKEF ATGRQDWAVH IALVENGVPT HAAVGLPDLG
VVFHSADARA VTGPYSKVIA ISHNRPPKVA LSCAEQLGFE TKALGSAGAK AMHVLLGDYD
AYIHAGGQYE WDSAAPVGVC KAAGLHCSRL DGSELTYNNK DTYMPDILIC RPELADELLE
MCAKFYEENG TY > RXA00113  (1-3294, translated) 1098 residues
ASGGGVVDSA ALDAYASTVT GEEGVLANVA RGILSQLGLD TKDEVEGAEI DTELYDAVEA
ELGTGWLKLV TPVFSADRAI LFDDRWASAR EDLARLANGE DIAVERFAGT GETVVKQAAW
WAEHVEDTAL AATLKQVSEV AAKPANEPHI DDVALVTGAA PESIAGAVAA RLLSQGATVI
LTASNVSQAR KEYARKLYAA NATPNAKLWI VPANMSSYRD VDAVIDWIGN EQRVTVGSTV
TVTKPALTPT LAYPFAAPSV SGTLADAGPQ AENQARLLLW SVERTIAGLA DLASRGVDGR
VHVVLPGSPN RGMFGGDGAY GEVKAAFDAI LAKWGSETGW PQFVSLAQAR IGWVAGTGLM
GRNDVLIPAA EKLGIHVYTP EEISSELLGL ASAESREKAL EAPIDYDLTG GLSGGVSIAA
LAASLESDAV ETTSAAEDTI KALPSPKHPE QPVGTPVGEV KTDLEDMVVM VGVGEVSSWG
SGRTRFEAEY GIQRDGSVDL TAAGVLELAW MMGLISWSED PKPAWYDADG TEVPEEEIYE
RFRDEVIARC GVRELVDDAF LVDGGSLDAA EVFLDRDISF SVTSAEEAQA YVDADASVTV
EEADGEWIVT KKKGSTSFVP RKATLTRSVA GQLPTDFDPA KWGIPASMID ALDNIAAWNL
VTAVDAFLSS GFSPAELLQS IHPADVSSTQ GTGIGGMQSL RKLFVNRFLG QDRPSDILQE
TLPNVVAAHT MQSYVGGYGQ MIHPVAACAT AAVSVEEGVD KIRLNKADFV VAGGIDDIQV
ESLTGFGDMN ATADTQAMLD KGIDPRFISR ANDRRRAGFL EAAGGGTVLL ARASVAAELG
LPVLAVVAHA QSYADGAHTS IPAPGLGALG AARGGKKSVL ARELNKLGLT PDDVRVVSKH
DTSTNANDPN ESELHNLLWK TIGREADNPM FVVSQKSLTG HSKGGAALFQ IGGLVSILET
GKLPQNASLD CVDPEMEAKG ENFVWLRKPL DLGAGSIKAG VLTSLGFGHV AAVVVLATSG
IFEQAMRNAG LDVEAWRARA TQRLRTGANR LEAGMVGRAP LFEQVDGRRL PEHGAHQAEI
NLLIDADARL GADGIYQG > RXA00158  (1-2085, translated) 695 residues
VTELSRNFGA SRLINRFGQE PFAFAFAGQG YDWLKTLRAA VAAGAGTNVS DIVERANALL
ALVADDLIGT LPFGFDPVAW ANNSEDPAFD TAQSAVSVPG IFVSQIATLD SLEAQRLDVD
QAVSSIGHSQ GVLGVHLLND ATRADELVAI AQLIGAAITR TARMTGLIAQ GDNMPMLSIA
GISREQLQQA IDAACAEVPA EIRPVIGLRN SRDSYVLVGR PDDNARVVKV IEAMAAKDKK
AIEDKLRGGS AFSPRITPLK VQAAFHHPAM NMAVEQTVAW ATTAGLDVEL TREIAADVLV
NPVDWVARVN EAYEAGARWF LDVGPDGGIV KLTANILEGR GADSFYVGDA AGQAKIFDAG
MAPELPVDYQ EFAPRVEHVD GTPRLVTKFT ELTGRTPMML AGMTPTTVDP AIVAAAANGG
HWAELAGGGQ VTPELLETHI AQLTDMLEPG INAQFNSMFL DPYLWKMQIG GKRLVPKARA
NGASIDGIVI TAGIPEKDEA VALVKELMRD GFPWIAFKPG AIKQVNSVLA IAKEVPELPI
```

Appendix B, page 1

```
                                                    Attorney Docket No.: BGI-125CP IIQIEGGVAG  GHHSWEDLDE  LLIATYGKVR  ALDNVVLCVG  GGIGSPERAA  DYVTGSWSTS
YGLPAMPVDG  ILVGTAAMAT  KEATTSQAVK  ELLVSTQGSD  EWVPAGGAKN  GMAYGRSQLG
ADIHEIDNSF  AKAGRLLDEV  AGHETDLQAR  PDEII > RXA00164  (1-1689, translated) 563 residues
VGRIPRAKWW  FLGALVLLSA  GAYASVLVPQ  VLGRIVDLVS  DGAQMRDFVE  LSVILIAVAI
AGAVLSACGF  YVVSRISEKI  IANLREDMVG  TALGLPTHQV  EDAGSGDLVS  RSTDDVSELS
AAVTETVPIL  SSSLFTIAAT  IIALFSLDWQ  FVLIPVVVAP  VYYFASKHYL  SKAPDRYAAE
RAAMAERARK  VLEAIRGRAT  VRAYSMEDAM  HNQIDQASWS  VVVKGIRART  TMLILNMWML
FAEFLMLAVA  LVIGYKLVID  NALTIGAVTG  AVLMIIRLRG  PMNMFMRVLD  TIQSGYASLA
RIVGVVADPP  IPVPDSGVKA  PQGKVELRNV  SFSYGDSWAV  KDIDITINSG  ETVALVGASG
AGKTTVAALL  AGLRVPDQGQ  VLVDDFPVSH  LSDRERIARL  AMVSQEVHVF  SGTLRQDLTL
AKPDASDEEL  AHALGQVNAL  DWLESLPEGL  DTVVGARGIQ  LEPVVAQQLA  LARVLLLNPA
IVIMDEATAE  AGSAGASALE  EAADAVSKNR  SALVVAHRLD  QASRADQILV  MDKGEVVESG
THQELLDHGG  IYQRLWTAWS  VGR > RXA00181  (1-1572, translated) 524 residues
MSDNTWFIIA  IVIYMLVMVL  IGYWSYRKTE  KYDDYMLAGR  GLNPFVAAMS  AGASDMSGWL
LMGLPGALFV  TGMSELWIAV  GLTIGAWANW  MWVAPRLRSY  SEISANSITL  PSFFENRLRD
KSRALRIIAA  LIIIVFFTFY  ISSGMVAGGV  YWESTFGGDY  LLGMAIVAGV  TVLYTFIGGF
LAVSYTDAVQ  GTIMFFSLII  VPVMAYFALA  NPMDIWSFAN  SNDYGPHTDG  IGNPTYFSMI
SGISAAAIIG  NLGWGLGYFG  QPHIVVRFMA  LRTPAEAKQG  RRIGISWMII  CLIGATFTAI
ISTVFFAQNP  DANITDTRAY  ESIFLDLARM  LFHPLIAGLI  LTAVLAAIMS  TMSSQLLVTA
SSLIEDLLKV  VKKDSLSERT  LIMLSRATVI  ILAIIAAAMA  INPSDSILGL  VGFAWAGFGS
AFGPIILASL  YWKRLNAAGA  ISGMITGAIV  SIAWGMSPLS  DTLYEIIPGF  ALATIVMVVV
SLLTKEPSEE  ILNEFETAKD  LAAAVESNED  VDFADAAQKL  SKES > RXA00186  (1-747, translated) 249 residues
MGEKTSVAYV  HDVLIKGVPV  RIYNPHPNDG  PLPVFIYFHG  GGWVLGDLES  VDSTVRDIAV
ASGALCISVD  YRRAPEHPFL  AALDDCQVVT  EAVLNGELAS  ANQHLVAVGG  DSAGGNIAAV
IAQQLRDQIT  HQVLVYPVMD  VILLVICSII  TTGFALLMHP  KSKDKTETIS  DEFLAEIQAG
SEKISILRST  PAEKANASRW  IMYFVGGIGL  LYSVFSLWTG  GVTGLTLNSF  NFLFLSLGMV
LTANYGPEY > RXA00187  (1-351, translated) 117 residues
VISGFFTSIS  TATTWPVIAF  LYSGLLNIAV  PSGGSKFIIE  APYIIPTPVD  LGADMGLVLQ
AYQMSDGATN  LLIPFFALPY  LANFKIKFSQ  VVGYTVPPVL  VVIAVICIYL  FLRASII > RXA00201  (1-186, translated) 62 residues
VADCGLPIPE  HVEIIDLALV  FGIPTFEQVL  NALKPEVVVE  GAVIAEGAPQ  RIREMVDTDV
EV > RXA00228  (1-591, translated) 197 residues
MRDLRSMIGV  SSSALGNRIP  SEEKVSDLVI  SAGYAILGRW  REDYDEMDFG  QATEILEQVG
AMHLADRTWG  TLSEGERKRV  LVARALMTNP  ELLILDEPTA  GMDLGGREDL  VGYLGELAMD
PDAPAIVMIT  HHVEEIPAGF  THAMLLDEGE  IVAQGLINTV  MTNENLSKAF  HQPIQVDRIG
ERYFARRVRT  ARSHRAQ > RXA00243  (1-927, translated) 309 residues
VTSEQALDPI  HPGQFRLSRI  QLINWGTFHG  TVDIPVTREG  ILVTGGSGSG  KSTLIDAITA
VLLPQGKLRF  NSAAQANTPR  NKGRSLVTYI  RGAWRAQEDP  LQDQIVSTYL  RPRATYSLVG
LTYSNGEGVE  HTLVAIFYLK  SGHNLTSDIS  SYYGVFPVDQ  DINALLDFLK  EGIDKRQIRA
AFKEAIFSEQ  HSVFSGRFRS  RLGISSEEAL  LLLHRAQSAK  DLQSLDDLFR  DYMLVEPDTF
SIAKTAVEQF  QDLEGAYEQV  EDIKRQIHTL  DPLVQLKNRR  EKAQQSKDHA  NALKKALPTV
GNRIKKEEQ > RXA00259  (1-2202, translated) 734 residues
MSGLFTPFSD  AAKNNTVKTD  GDSVSGRDLP  ITKISEDRFE  RSAYSAQLAN  IICDVAPWGA
STVFSLTGQW  GSGKTSLVNL  IRSEESLSNE  KWTIVDFNPW  VASDPQSLIE  EFYRVIVGTV
PDDKTGQKIK  TVLQKTFSTI  GSIAGGVGGF  GVLEALALSK  GVDAANAVYK  TWKQEQDSWP
TLYTRAANHF  KDLNKRILIV  VDDIDRLHTD  ELALLMKVIR  LLGRFPQVNY  LLVYEEESLL
```

Appendix B, page 2

Attorney Docket No.: BGI-125CP

```
TTLARSTAVG GSEDDALRFM EKIVQYPFDV PPLTSFQIEK ELSALFDKLF QGVSLSGDPE
DFALVKSRMF DVWEKTLVTP RLLHRFAALL TNWTRIYGSG EVNGVDLTIL ATIRIVFPSV
YKRLSRAKEV LLQGGRTTGS QKPGWEKQLC EGMNNEQMDL LKTMLLFLFP RLSDHPSTRM
HRERGISTEV YFDTYLMFQR PGHVISDEQL DKYLSNADDA MGFVDLINSD DNDMVASVMK
KLPLAIDRLD GEGVRHMAVE VLFTAANGMH DKGRQVRMSG IFSDLYSHAC SILGALPQLP
VEQLYEKFFS EMTLNEAAFW LNQVGERARA CGNDVSGLEL FRKVNIKTEA RILSVLKNQD
PSDWDLGPYS LGILAKSSNF SSVLKSLQSG IEEHQFDVID IGVLFLTTVY SSRQGPSGGA
WIDSFQHSLF SRYVPDSLRA ITKSEVDVEL GKIQFTDFSW EGKRKVVAYA LETGRSDFTR
ERLGGYSIAD SIVD

> RXA00269 (1-789, translated) 263 residues
MLSINGISKT FFPGTVNERR ALQQLKLDMA EGDFVTVIGS NGAGKSTLLN AVSGRLLVDS
GEISIDGNKV NKMSEHKRAR YIGRVFQDPL AGTAPNLTIE ENLAIALLRG KRRGLGFALT
SKRREQFKQE LERLELGLEN RLTAKVGLLS GGQRQALSLL MAGFTQPKIM LLDEHTAALD
PQRAELVTTL TEKIVADGNL TTLMVTHNME QAIRLGNRLI MMHEGQIVYQ ADQATKSKLT
VRDLLQEFAN IKGATLSDKA FLG > RXA00281 (1-684, translated) 228 residues
MINVEGLTKQ YGQVRAVDDL SFEVKPGIVT GFLGPNGAGK STTMRLILGL DNPTAGHATI
EGQPYRSLKN PLTKVGALLD AKATHPNRTA ENHLKWIARA NGLSTKRVDE VLTLVGLTGV
GSKKTGGFSL GMGQRLGLAA ALLGDPEYLI LDEPVNGLDP EGIHWVRTLL QNIAKQGRTV
LVSSHLLSEM AQTAEHLIVI GRGKLVADMP MHEFVRSHSA STVVVRAA > RXA00298 (1-1845, translated) 863 residues
MSSNIAITTE PEGKNKKGLK SDPFIFSISV GFIVVFVIAT IALGEKARTT FSAIAGWLLE
NLGWMYIGGV SLVFIFLMGI FASRYGRVKL GDDDDDPEHT LIVWFCMLFA GGVGAVLMFW
GVAEPINHAF NVPMANEESM SEAAIVQAFA YTFYHFGIHM WVIMALPGLS LGYFIYKRKL
PPRLSSVFSP ILGKHIYSTP GKLIDVLAIV GTTFGIAVSV GLGVLQINAG MNKLWSTPQV
SWVQLLIILI ITAVACISVA SGLDKGIKLL SNINIAMAVA LMFFILFTGP TLTLLRFLVE
SFGIYASWMP NLMFWTDSFQ DNPGWQGKWT VFYWAWTICW SPYVGMFVAR ISRGRTVREF
IGGVLALPAI FGVVWFSIFG RAGIEVELSN PGFLTQPTVV EGDVPAALFN VLQEYPLTGI
VSAFALVIIV IFFITSIDSA ALVNDMFATG AENQTPTSYR VMWACTIGAV AGSLLIISPS
SGIATLQEVV IIVAFPFFLV QFVMMFSLLK GMSEDAAAVR RVQTRQWEKT DTPEKLEEHS
SQPAPGYDDE GNPLPMPALE HDEDGNIVIP GNVVIEGDLG VVGDVVDDPE EAQEMGSRFK
IVEQTRPQSR DEYDI > RXA00346 (1-690, translated) 230 residues
MLLTFNDAAV DPLWRGLNLE LRQGEFLAVL GPNGVGKSTL IGTILGTRKL THGSVKTDAR
VGYIPQQRIF DVPLRARDMV SLSAAHGVVS KRGPAKGDVD KLLARVGASG IADRRVGELS
GGQQQLVRQA QALATRPQLL LADEPLLSLD PGVAQRTVSL FGELKAEGVG VVVVTHDVNP
LMGLVDRILY LAPNGHTIGT VGDVMQSEKL SELYNAPVTV ARINDRIVVV > RXA00368 (1-579, translated) 193 residues
SLMLSLGAAL ICGVLGWLIG VLITRTQHFA NVPLTLTVLL PTALPGMIIG VGWLILGRYT
GIYNTPWVIL GAYVCAFTAL VVQAVRGPLS QAPEAIEEAA RISGAGRLRS IMDTTGAMAI
PAAFAGAVLV AVTARELTV SILLIAPGTT TLGVQVFNLQ QAGNYNQASA LSLMFAIIGI
VALALTVRSQ KEF > RXA00369 (1-717, translated) 239 residues
VSSIKLRDLS VSFRDGTFGL QDINLKIEPE EFVVLIGPSG SGKTTMLGTI AGFVEPSSGS
VLIAGEEMTH VPPERRRMGM VFQQHAVWPH MSVAKNVGYP LARSGQKGAS ISKRVERTLA
LVGLEGFGSR RPASLSGGQR QRVALARAII ADPTVLLLDE ALSALDEPLR DALRRELVSL
TRREGLTTVH VTHDRAEAIS IADRIVVLGN GRIQQVATPT ELLSAPATAD VARFIVDAT > RXA00370 (1-798, translated) 266 residues
GKALWNSAYT TVLSAVGATI IGTIMALTLD RTDVFGRTAL RLFLLSPLLI PPFIGAIAWL
QLFGKNQGIN RFFGTEVWDI YGADGVTFLL IVHSYPTVYI IVSAALRQLP SDLEQAARIA
GADTFTVLRT ITLPLLKPAL LSAFTLTTVA NLADFGIPAL LGSPARFETL ATMIYRFMES
GTVSNPLQVV STIGIVLLFL GIAAVTADYL VSLYAASKLQ DAGTPHRFTL NKSRIPVSVI
TWIIALIITA APLLGLAYRA LLPAPG
```

Appendix B, page 3

Attorney Docket No.: BGI-125CP

```
> RXA00410 (1-666, translated) 222 residues
MMIYGKGSTE VRALDGISVQ IQSDKWTSIM GQSGSGKTTL LQCLSGLAQP TSGRVTLNKN
NITLSSLSEN KRAKLRRTHI SMVFQDFNLV PILSVKDNIL LPLRLAHRRV DKQWFEHITS
VLKIDNRMRH LPGELSGGQQ QRAAIARALM SRPDIVIADE PTGSLDSVTS DAVLNLFRSI
VDDFGQSLVF VTHDKDAAHR GDVLITMRDG KIIDTADLRV GR > RXA00419 (1-462, translated) 154 residues
DNEAQWRDQA LAVEATTVNY TAGVSVGVLL GQKFEQQGHG TIVALSSVAG QRVRRSNFVY
GSAKAGFDGF YTQLGEALRG SGANVLVVRP GQVRTKMSAD GGEAPLTVNR EDVADAVYDA
VVNKKDIIFV HPLFQYVSFA FQFIPRAIFR KLPF > RXA00421 (1-159, translated) 53 residues
MLNAVGKAQN ILLLGGTSEI GISIVSRFLK QGPSHVTLAA RKDSPRVDAA VAE > RXA00432 (1-891, translated) 297 residues
LSALVIFGGV QRIANVTQWM VPFMAGAYII VGVVVIVINI QQVPTMINDI IAGAFGFRPV
ATASVWGAFW LAFMNGMRRG LFSNEAGEGS VPNAAATATV SHPVKQGLVQ TLGVYFDTLL
VCSITAFVIL LSGVEYATGD IQSSSLTQSA LASVVGGWGT HFITVVMFFL AFSSVLGNYY
LAQANIQYFT DSKTVMTVFR LLVLLSVFSG AVASVPLIWA LGDTFAGIMV LINLAAIIPL
GGVAVKLLKN YTIQKKAGLD PVFHRDMMPE VRNIACWNGK DAATSNYHEA MEVIKKS > RXA00436 (1-525, translated) 175 residues
MELLETFITD VINDNLWMIL PFLLVAAGLY FGGRTLLVQI RMIPEMFKAV VEKPAKDGEF
ADKQDISAFK AFTISAASRV GTANVAGVAL AITLGGPGAV FWMWIIALVG GATSFIESTL
GQLWKVKDGD SYRGGPAYYM TLGLNARWLA VVFGVAITLT FGFVYNALQS NAVVE > RXA00449 (1-1005, translated) 335 residues
LALTAETVGG MKNQKKFATG LMLSIAYSAS IGSLGTLIGT PPNALLAAYM SESHDIHIGF
GQWMILGVPI AVVFTIIAWL VLTTVFKPEM KEIPGGRELI KREIAEMGPW TAPQVTVGVI
FAAAALAWVF IPLTLDWTGS QLSINDSLIG IAAGLLMFIV PANFKTGERI LDWRTAGELP
WDVLLLFGGG LSLSAMFTST GLSLWIGELA KGLDALPIFI LIFAIAVLVL FLTEFTSNTA
TAATFLPIMG GVAVGIGLTA GGEQNVLLLT IPVALSATCA FMLPVATPPN AIAFGSGYIK
IGEMVKGGLW LNIIAVILIT IFTYFVAIPL FGIML > RXA00456 (1-312, translated) 104 residues
VLQALLAIMV SLSVAAILEG NRALVGLLLA TTLGLGVAQW IQKVVAEDLG QHYVHEVRRE
LVGAALVPGN TASLGVTVTR ASNDLTAVRN WVALGIVPMV TGLP > RXA00459 (1-987, translated) 329 residues
VCTRAAGGGA VTLKRARELR KKRGRMAARI ADSVMAGELL HATGAIDREL NAVTRDSDRV
VIAAVRRSWA TGFSRALMAM AASLGTVSIV ISGHLEVSEV AGIMMLLGVL ATPVAELGRV
VEYRQNYKAA TRILIPLLQR GSEFKHSQQK LPGLQATEGI PGVYVKGISA LPGERIYLHG
SADATRKWVT SLSAMEEGTD VIVNGQRLSQ LPLKQRRALI GIASAHHHLS RGSVSRLVGL
RVPDATVEEI EQALEQVGLN NTGKQRLKNG GHPWSTSQIN KLKIASATLR TPPLLVLEGI
TPENLLNYPG VIISTVQENP SETWRQVNI > RXA00477 (1-1644, translated) 548 residues
MKVSTKTPRS SGTAVVIGAG VAGLATSALL ARDGWQVTVL EKNTDVGGRA GSLEISGFPG
FRWDTGPSWY LMPEAFDHFF ALFGACTSDY LDLVELTPGY RVFSGTHDAV DVPTGREEAI
ALFESIEPGA GAKLGNYLDS AADAYDIAID RFLYNNFSTL GPLLHRDVLT RAGRLFSLLT
RSLQKYVNSQ FSSPVLRQIL TYPAVFLSSR PTTTPSMYHL MSHTDLVQGV KYPIGGFTAV
VNALHQLALE NGVEFQLDSE VISINTASSR GNTSATGVSL LHNRKVQNLD ADLVVSAGDL
HHTENNLLPR ELRTYPERYW SNRNPGIGAV LILLGVKGEL PQLDHHNLFF SEDWTDDFAV
VFDGPQLTRP HNASNSIYVS KPSTSEDGVA PAGYENLFVL IPTKASSSIG HGDAYMQSAS
ASVETIASHA INQIATQAGI PDLTDRIVVK RTIGPADFEH RYHSWVGSAL GPAHTLRQSA
FLRGRNSSRK VNNLFYSGAT TVPGVGIPMC LISAENIIKR LHADTSAGPL PEPLPPKTTP
SQKTSYDH > RXA00478 (1-831, translated) 277 residues
VIEEYSTSFS LSTWLLSPRI RNDIRNLYAV VRIADEIVDG TAHAAGCSTA KIEEILDAYE
IAVLAAPQQR FNTDLVLQAY GETARRCDFE QEHVIAFFAS MRKDLKANTH DPDSFTTYVY
```

Appendix B, page 4

Attorney Docket No.: BGI-125CP

```
> RXA00480 (1-1116, translated) 372 residues
MDNGMTITTE HSTHPDLDFN DEIYRELNRI CASLSQQCST YQPEFRTCLD AAFQALRGGK
LIRPRMLLGL YNTLVDDDIE VKLNTVLQVA VALELLHFSL LVHDDVIDGD LYRRGKLNFI
GQILMHRTPE SFAQIQRDPE HLDWAQSNGL LMGNLFLAAT HQIFARLDLP HHQRVRLLDL
LNHTINDTIV GEFLDVGLSS KAISPNMDIA LEMSRLKTAT YTFELPMRAA AILAELPQEI
ETKIGEIGTN LGIAYQLQDD YLSTFGDAAE HGKDAFSDLR EGKETTIIAF ARDTAKWTDI
QDNFGSADLS TSQAERIQHL LIQCGAKNHS LNAISDHLNI CRSMIKTLSP QVDPKAQNLL
LKQVEQLASR KS > RXA00524 (1-333, translated) 111 residues
VTTNHQLSAE EISLAYGERT IIDSLSVDIV PGKITSIVGP NGCGKSTLLR AFARLLKPSA
GQALIDAHPL PSLPGKELAR MLGLLPQSPT GPEGIVVADL VGRGRHPHQG L > RXA00526 (1-690, translated) 230 residues
MSLIEMRNIV KTYNIGSEGE LTVLHGVDFH VDRGEFVSVV GTSGSGKSTM MNIIGLLDKP
TDGTYTLDGV DVLDISDDAL ASHRAKSIGF VFQNFNLIGR IDALKNVEMP MMYAGIPAKQ
RRSRAVELLE MVGMGERLNH EPNELSGGQK QRVAIARALA NDPEIILADE PTGALDSATG
RMVMDIFHQL NKEQGKTIVF ITHNPELADE SDRVVTMVDG RIIGSEVKHS > RXA00559 (1-213, translated) 71 residues
MSDNPHENPR ENPHRSPEVV LRFMAAPTDV LMAGSHGVGG GRVLEWIDKA AYACATHGSG
TYCVTAYVGH I > RXA00570 (1-498, translated) 166 residues
PTIVMAMVAG IFLRFGLDLI DASVTDPLIA LPMVIVFVAL SMSPRLASIA PPVAVAAVVG
TIVAIASGKL ASGILDNGII SRPVFTAPEF SFAAIMELVV PLAITVVIVQ NGQGVAVLKA
AGHRPGVNLA AAASGLWSLP MALIGNITTC LTGPTNALIV AGAKSH > RXA00571 (1-1185, translated) 395 residues
QIGALSPAVA GTLGSYAMIG VMIGALSAGA VGDRLGRRKV MLTAIVWFSV GMALTAFASS
IALFGFLRFL TGLGVGMIVA TGGAIIAEFA PANRRNLFNA IVYSGVPAGG VLASILALFF
EDVIGWRGLF LIGGSPLLFL LPLAYFFLPE SPRWLTSRGR AADAKALCAR YGLPTEEFVV
EKQQETKGTG FAGIFSSKYL MGTILIGAMS FIGLLSTYGL NTWLPKIMES NGATSHDSLY
SLLFLNGGAV FGGLIASWFA DRIGAKTVIT STFALAAICL GVLPNISSWP MMYTAIAFAG
VGVLGTQVLT YGLTSNFFGT ECRAAGVAWC AGFGRLGGIV GPAIGGLIIG AGFGPSSAFL
IFAAAAAIGA VCTLLIPRSP AEVEVKVAQE PLARV > RXA00572 (1-3831, translated) 1277 residues
QWLNRYLELS GPVDGQWIDA SWAARFAQML ERAEARLIEQ DHGQFEPSLT VEDGVDKLVA
AYPHAATDLL TPADVAWFLG LCRTPGKPVN FVPVIDKDVR RWWRSDSLWQ SHDDRYTADQ
VAIIPGVVAV AGITKANEPV ADLLDRFVDA TIERIDEHDS RSRDIMGKVL SSPGTFWAGR
NIPSVIHSLG HADKWSRSEF EAFHSPTGAN LVYEDAEHAM LTVPLAGSTA FGTTAELKIR
FTSPIDALPS AVPLVTQEDA EAAMGELTRI AAGGTLATVN NGTATWETSV DAGVIADYNN
VTAGYLPASV VPAHTAPDVL VGRAWPAVFA AVKSAVIPGT DSASVVEGML SLVHLEHHIV
LKSDVPTDGA LKVSATADEV VDTDLGRLVI VRAEIADAEG NLIATLAERF AIRGRKGNAV
ARTNTSALPT TVDTPRSARA VATVVAPESM RPFAVISGDR NPIHVSDVAA SLAGLPGVIV
HGMWTSAIGE LIAGAAFNDE QIQTPAAKVV EYTATMLAPV LPGEEIEFSV ERSAVDNRPG
MGEVRTVTAT VNGNLVLTAT AVVAAPSTFY AFPGQGIQSQ GMGMEARRNS QAARAIWDRA
DAHTRNKLGF SIVEIVENNP REVTVAGEKF FHPDGVLYLT QFTQVGMATL GVAQIAEMRE
AHALNQRAYF AGHSVGEYNA LAAYAGVLSL ESVLEIVYRR GLTMHRLVDR DENGLSNYAL
AALRPNKMGL TADNVFDYVA SVSEASGEFL EIVNYNLAGL QYAVAGTQAG LAALRADVEN
RAPGQRAFIL IPGIDVPFHS SKLRDGVGAF REHLDSLIPA ELDLDVLVGR YIPNLVARPF
ELTEEFVASM AEVVESTYVN EILADFKAAS ADKQKLARTL LIELLAWQFA SPVRWIETQD
LLIKGLQAER FVEVGVGSAP TLANMMGQTL RLPQYADATI EVLNIERDRP VVFATDEVVR
EVAVEETPAA PAETTETPAT PATPAPVAAA APATGGPRPD DISFTPSDAT EMLIAIWTKV
RPDQMGATDS IETLVEGVSS RRNQLLLDLG VEFGLGAIDG AADAELGDLK VTVSKMAKGY
KAFGPVLSDA AADALRRLTG PTGKRPGYIA ERVTGTWELG QGWADHVVAE VVIGAREGAS
```

Appendix B, page 5

> RXA00590 (1-387, translated) 129 residues
MRVVLFLAVL GVVAGGVTLS TTGNPAAEAF QHAAGDIGLR IFGAVLWAAS ISSVIGASYT
SATFLVENKP EKKRLQNWVT IIFILISCSV FIMLGTAPAI LLVFAGAFNG LVLPVGFTLM
IYVAIFRQK > RXA00591 (1-1353, translated) 451 residues
MTTSSTASPI AELQNLSPKQ RKSESRRAII SSYLGSTIEF YDFLLYAAAS ATVFPAVFFT
NLDPLAGTIA AYGTFAAGYL ARPLGGAIFG HFGDRLGRKK MLVLSMLIMG VASTCIGLVP
SAEMIGSMGA VILIMLRICQ GIAVGGEWGG AALMALEHSD SKKRGFAASF TNAGAPTGAA
LGTFALGTAS AVLTQEQFLS WGWRIPFLLS FVLLIVGLVI RAKVSESPLF AAAAAAEKAK
PTERKVPLLQ VLRRPKALIL TMLGGASGFG LQVLLSTFSI SYATQSGIER SSVLYAFAVA
SVFSVFFVIL FGRVSDLFGR RPVMIIALVL FVAYLPAFFR MLTSDNWFIL LSAFTIALAL
HAMLYGPLAA FISEQFGTSA RYTGASLGYQ LATLIGAGFT PTILASLYAG PGGGTSVTPV
IVFLATMSLV SIIAIAITRE SKDHDLSTYE H > RXA00596 (1-453, translated) 151 residues
MLNALKFIPW LIGQIFLSGF SVITAAVKKD TGFNPVVIRY PLRVTTDFQI AALSTCITAT
PSTLSLGLRE PRKPGDPTIL LIQAVFGSDP VEVFESIADM EQRLVPSVAS IDHGVPGQGP
YKEIRPSDAE WPSREIADTA QNTVSQDKRE F > RXA00607 (1-381, translated) 127 residues
MILALTVAIL FGGGVYLIQQ RGMVRIVFGM SLIGHAANLT ILYAGVPTWR GEAFPDRTPL
TDAADPLPQA FVLTAIVIAM ATTTIMLALA ALGRSDDTRS IEPDDDQSPL TTSARSVTNP
TDQEDKA > RXA00623 (1-1338, translated) 446 residues
MDSNTESSSV EVKNEHIKVQ KPPKKDRTHW LYIAVIIALI GGITLGLISP ELGKEFKILG
TMFVSLIKMI IAPVIFCTIV IGIGSVKAAA TVGRAGGIAL AYFITMSTFA LAVGLLVGNF
IQPGSGLNIS VDEESSFAST ESSPEGLLGF IHSIIPETFF SAFTDGSVLQ VLFIAILVGF
AAQSMGEKGQ PILDFVSHLQ KLIFKILNWI LWLAPVGAFG AMAGVVGETG FDAVVQLGIL
ILAFYVTCVI FIFGVLGAVL KVFTGVNIFK LVKYLAKEFL LIFATSSSES ALPNLMRKME
HIGVAKPTVG IVVPTGYSFN LDGTAIYLTM ASIFIADAMN MPMSLGEQVG LLVFMIIASK
GAAGVSGAGI ATLAAGLSSH RPELLHGVDV IVGIDKFMSE ARALTNFAGN SVATLLVGKW
TGTVDMNQVH DVLNGKSPFV ELEEDH > RXA00660 (1-1023, translated) 341 residues
PGHTPEHLSF LLKDGAFAHE PGFMLTGDFV FAGDLGRPDL LDEAAGGVDT RFEGARQMFK
SLKEKFLTLP DHIQIFPGHG SGSACGKALG SVPSTTLGYE RQFAWWGKYL EADDEQGFID
ELLEGQPDAP AYFGRMKRQN RQGPAIMGAR ELLPQLEASD LHDVIVVDTR SADEVHQGTV
AGAVNIPAGN SMAKFGSWTV DPEKDSRALV LLAASQIGAM EMWDHMVRVG IDNVAGFITN
FDGVDLVAPQ TVSPDQLDEL EYDLLLDVRN RSEVEEGYIP GALHINGASV LWNLEKLPRD
GKIVSYCKSG TRSSIAASTL RNAGFDVVEL QGSYDNWVRH N > RXA00681 (1-744, translated) 248 residues
MPSPRTVLIT GAAGGLGRAF AEGFAAQGDR IAVADINLDG AQETVDKLKA LGADAAAFEV
DVTSLESTEA LAAGAAEFGG GRIDVLINNA AIYATVTRSP FEDIDPAEWD LVMGVNLKGP
WLVTRSVSPF LSDNARVVNL SSATVFSGSA HWAHYVASKG GVIALTRVLA KELGGRGITV
NAVAPGFTLT EASLGLMDSA ETYGVDRGSI KRASQPKDIV GTTMFLASPE AEYITGQTLI
VDGGRQFI > RXA00690 (1-1146, translated) 382 residues
VKWIERYVLS RRMVHPWAWW VWALGIAGCA SMTNNPYILA LTFATLCFVV FNRRGSSPWS
RAFPIYLMIA GWLVVYRLVM HIVVGAKIGT IELFRIPPVQ LPEWAAGIHV FGTVYLEGLI
IATTQGLTLG TMIVAVGAAN SLADPKKLLK SLPGALGELG TAVVIGISIA PQMAESAFRI
NRARTLRGDD AKGVRGFARI LMPVFQDTLD RSLALANSMD ARGYGRQAHV SKFQQRVTSI
FGAFGILGVT VGLFVVLDAS SPMFVAVPVF ITGVGFLIIS LVVASHRKTS TTFDQLPWGA
AEWLVCITGV IPLLMAALTR YLDPGSMITT WVPLHMPDTV PLLVVAGLVV ATMPGFLTPR Appendix B, page 6

LPKNKVRVKR RKAINSPERA EV

> RXA00733 (1-408, translated) 136 residues
MSNTAGPRGR SHQADAAPNQ KAQNFGPSAK RLFGILGHDR NTLIFVIFLA VLSVGLTVLG
PWLLGKATNV VFEGFLSKRM PAGASKEDII AQLQAAGKHN QASMMEDMNL VPGSGIDFEK
LAMILGLVIG AYLIRS > RXA00735 (1-669, translated) 223 residues
GPTGAGKTTL VNLIMRFYDI NSGSITLGET AQDAVDIRTM AREDLRSRTG MVLQDTWLFA
GTIRDNILYG RPEATEEEML AASKAAYVDR FVRSLPEGYD TVLDDEAMNL SVGERQLITI
ARAFLANPRL LILDEATSSV DTRTELLIQR AMSKLRQDRT AFVIAHRLST IRDANLILMM
KDGEIVEQGN HRELMALEGA YWELYNSQFN APAKEELQAD GDH > RXA00796 (1-198, translated) 66 residues
MSKIAIITGS TRPGRVNIDV ANWVLERAQE RNDAQYELVD IADFNFPVLD EAMPAGYGQY
ANEHTK > RXA00801 (1-633, translated) 211 residues
MAHDGLRVEN IVTSGIFALD GGEWEVDNNI WVVGNDDEVF IIDAAHTAAP IIEAVGGRAV
KGILCTHAHN DHITVAPELS KEFDAPIFVH PGDQMLWEET HGNLTHEDLA DQQKFQIAGT
ELIVLNTPGH SPGSSCFYLP EANELFSGDT LFQGGPGATG RKYSSFDTII ESLKTSILDL
PAETTVRTGH GDHTSVGAEA PHLEEWIKRG H > RXA00802 (1-714, translated) 238 residues
MDLKLGGQVI LVVGGAGTIG SEVVKLLTEE GATAVAASRS TPLSIDASDE ASVRAGIDQV
IAEHGRLDGL VVSSAPAAQT LSAETADDPD TVLAAIEGKA ITFMKAATVA LEKMREAGHG
RIVALSGMNS YKTLSTTASA RNAALNVVVK NLADRHAGTG ITVNAISPGF VVAEPDAEVN
RANGDTTWRR SRRRSRFCCR RAPHQFLERL FRWDIRRRAS SFLSSRELPK RKHPRVRA > RXA00819 (1-990, translated) 330 residues
MVGGSPEQAQ RLDAQIKSGE VKGVFALTEP DHGSDIAGGL ATTATKDADT GEWIINGEKR
WIGGASTADL IATFARDTAD NQVKCFLVAP QAEGVSMEII DRKASLRIMQ NAHITYNNVR
VSGDARLHNI NSFKDVSECL RRMRSDVAWM AVGAQAGAYE AAVKYVRSRE QFGRPIAGFQ
LIQEKLALML GNLTASLGMM VKLTDQQQAG IFKEENSALA KMFTSLKLRE TASWAREICG
GNGIILDNDV ARFHADAEAV YSYEGTHEIN ALIVXXXILX XXFFLYYXXF EEDLHDYFHH
PKPSFLSKTH QPSPARTWAF RSGALSPRRW > RXA00821 (1-843, translated) 281 residues
VTKLERMEHP AYSQLRPVTP SASVVLCPNP GYSSLEGTNS WVIRAPEDPR SIVIDPGPED
EGHLNVLHSK AEEVGLILLT HRHYDHADGA QRFRQLTNAP VRAMDPSYCA GAEEIHDGEI
ITIDGVTPQI EVVATPGHTR DSVSYFIWSG VPHESTLEGI VSGDTIAGRH TTMISETDGD
LGEYLNSLAI LEERGKDIPL LPGHGPDGQD VSSFARKYIE RRELRLNQIR EVWETRGRDV
SMKDLIDAIY DDVDPVLRGA AEQSTHVAIR YLQAQEASAS N > RXA00827 (1-753, translated) 251 residues
VNLLIKINPV TRIIALMVLT TPLLLSLDVM SAAIALVATI ILAPFAGVTW KMLLKRGWML
FLMAPVAALS MALYGRPDGK EYFSFLLIHV TDNSLALAAA IGLRVLAIGL PVVVLIARID
PTDLGDGLAQ LLKLPERFVI GAVAGSRLMT LFREDWYSMS RARRARGIAD QGKIKHFFTM
TFGLLVLSLR RGSKLATAME ARGFGRTTGR TWARESTVGA RDLVLILVCA AISAIALTVS
IQTGFFKFLG T > RXA00842 (1-1200, translated) 400 residues
MIIQILRVAF AFVGIIVGAG FASGQEVMQY FVAFGIDGIW GVIVSAVIMS VMALIILQLG
SYFNAGEHGE VFRRVSHPVF SKILDIGVVV TLFSTGFVMF AGAGSNLNQQ WGLPLWIGSV
IMVLLVLAAG MLDVKVTTV IGAITPFIII FITAASIYTL VGNFSSVEQL DSAALEVGTT
LPHWAVAAVN YVGFNLMVAV SMAVVIGGSM FNPRVAGRGG LLGGLILGFL IISALTLFA
TVEEVGQDDM PMLTIINNLN PLAGQVMAVV IYGMIFNTAL GMFYALGRRL TAKNPQRFRP
VYVVTVLIGF VLSFVGFKNL VGYVYPVLGY IGLLLIAVMM VAWVRGRVRI YKESERRMRI
ADLLQIGHDG ALSGAELAVL NQEIQDSNLD EEQIKAAVRK > RXA00847 (1-1449, translated) 483 residues Appendix B, page 7

Attorney Docket No.: BGI-125CP

```
VACQANPGPA PVEEPTTATA TTTATETTTV ETEAPKQDRE TISIGIDPIR NGFNPHLLSD
DSPLVRDTAS LVLPSAFEGN QLNTDLLDNV EQVDETTVRY TIAQEAQWSD GTPITGSDFE
YLRRSIVAGT GTLNDSAYSA ISEIRTSGGG KTVDVIFEHP VADWHLLFNN LLPSHLITGN
STFQTAFYDS IPASAGRYMV RSIDRQRGVI TLSRNDRFWG ANPAHVEVLQ FNTVASASRA
GEYLRTGQSS FMNLSPQETL VDTLNLVPDT EVRVSDTTRT LELVFNAEAL APAQRAYLTS
LIDVPLTAKL AGGRSANLGV PQTVEASVDK QEIPALRLAA DPADDAGLAA ARGIVDMLAA
DGIKAQVVTT DLNSAIAGNF DAIVAWTRTA TDSIALADRV GCGVNLAKWC AEGTTEYING
VLAGEIDFDP AWEQQFNTEN HLRVPILRET RVEAKNNGIL GAADGWPGGI SSAASWRKND
VEE

> RXA00851 (1-609, translated) 203 residues
MNSIPLGFYV DKQSVVHSFP ALWKFPLLLF FIIGGSIAAS TPVHGLILVG IAVVFYVLAK
IPLKVAWEQL WPVLPILIML GAFQWWQRGF DFAATTVLTL FSAVMAAMLL TLTTRLEALM
NAVERMLQPF ARFGLPVETI TLAISLTIRL IPLQLATVKE VLDARKARGA GFSIAAFGTP
VIIRSIKRAR NIGDALLARG AGD > RXA00852 (1-690, translated) 230 residues
MPEIIFDNTE VRYDDSLILE PLSLKLTEQR IGIIGANGGG KSTLIRMING LGEPTTGRVL
VDGLDVSHSG REVRKKVGFV FSDAENQIVM PTVREDIAFS LRRHKMPRAE KAQRVDEMMA
RFNLSEHADQ SPHTLSGGQK QLLALAAVLI LEPEVIIADE PTTLLDLRNR LMIKDVFNKL
EQQLIVVSHD LDFLSDFERV ICINDHKIAA DGPPQKSIDL YVSLMAEPAK > RXA00856 (1-537, translated) 179 residues
VSDVSAGVNG AQDPSNQAVK PSNWNLPNFL TSLRIIVIPL FAWLTLKGET ENNAFAWWAL
VVFILLMITD KLDGDIARAR GLVTDFGKIA DPIADKALMT TAFVCFNIIG ILPWWVTALI
VLREFGITIW RFFQLRAGNV VPASKGGKLK TALQTVAVAL YLCPFPSWMD IPSQIVMYA > RXA00870 (1-1512, translated) 504 residues
MSEPQTISHW IDGAISPSTS GKTAPVYNPA TGQVTANVAL ASQEEIDATI ASATKAAKTW
GNLSIAKRQA VLFNFRELLN ARKGELAEII TAEHGKVLSD AMGEILRGQE VVELATGFPH
LLKGAFNENV STGIDVYSLK QPLGVVGIIS PFNFPAMVPM WFFPIAIAAG NAVILKPSEK
DPSAALWMAQ IWKEAGLPDG VFNVLQGDKL AVDGLLNSPD VSAISFVGST PIAKYIYETS
AKNGKRVQAL GGAKNHMLVL PDADLDLVAD QAINAGYGAA GERCMAVSVV LAIESVADEL
IEKIKERIDT LRIGNGAGDE QGEPHLGPLI TDVHRDKVAS YVDIAEADGA KIIVDGRNCA
VDGHEEGFFF GPTLIDDIPL TFRAYTEEIF GPVLSVVRVA SFDEAIELIN SGEFGNGTAI
FTNDGGAARR FQHEIEVGMI GINVPIPVPV AYHSFGGWKN SLFGDAKAYG TQGFDFFTRE
KAITSRWLDP ATHGGINLGF PQND > RXA00875 (1-567, translated) 189 residues
MTTEVELVVL ADSEGNPIGT APKATVHTKD TPLHFAFSTY ILNPRGELLV TRRALSKKTW
PGVWTNSMCG HPGPDETNAD AIRRRGVDEL GLEVDSFLDI QEILPDYQYR AVDASGIVEW
ELCPVHLVRL AVGEFVEPLD DEVEEFEWAE PQKLFDAVDA TPFVFSPWLV DQLSAPELRQ
AILEAFDAE > RXA00878 (1-1863, translated) 621 residues
MRLLGRILKT TSALWPYYLG IIVVSIVIAA LSLLSPFILR EATDSIVSAV TGSNTVDAVT
RTIIFLALAL FVASFLNTVM TNIGGYIGDV MASRMRQILA TRYYAKLLAL PQKYFDNQVT
GTIIARLDRS INGITQFMQS FSNNFFPMLI TMVAVLIISA IFYWPLAILL AMLFPIYMWL
TALTSKRWQK YEGEKNHEID VANGRFAEVV GQVKVVKSFV AETRELADFG GRYGKTVAIT
RPQSGWWHRM DTLRGAALNI IFLAIHLLIF YRTLHGHFTI GDMVMLIQLV TMAQQPVYMM
SYIVDSAQRA IAGSRDYFEV MAQQVEPTAN KELVDATLAS DTPRISVGTP AALPAGEPAM
EFKNVTFAYE EGKPVISDVS ITARHGERIA LVGESGGGKS TLVNLLLGLY KPNSGSLAVC
GVDVKDLTSE ELRASVGVVF QDASLFSGSI AENIAYGRPG ATREEIIEVA KKANAHEFIS
AFPEGYETVV GERGLKLSGG QKQRVSVARA MLKDAPLLVL DEATSALDTK SEQAVQAGLE
QLMENRTTLM IAHRLSTIAG VDTIVTIQNG RVEEVGSPTE LAVSGGIYSE LLRLTNSTAE
ADRERLRAFG FTGDAPAEEE D > RXA00880 (1-1845, translated) 615 residues
MTSPNTLQEY TEPAKYTIGE SETCLTALLD QIKTRPYGVL FSKPANYEWV NVTAKEFQDE
VFAVAKGIIS VGVEQGDRVA LLSNTRYEWA VLDFAIWAAG AVSVPIYSSS SLSQIEWIIE
DSGAVLAITE TPDHTDLMKN LVIGEDTPA IKGSPSKLRR ILEINSSALE TLKFEGRELS
```

Appendix B, page 8

```
DELVWERIHA TKAADLASLV YTSGTTGRPK GCELSHYHWL AEVRALITND IGAIAMPGSR
LLTFLPLAHV LARAVHLAFA VTGATQSHWS DFSTLTLELQ RSRPNLILGV PRVFEKVRNA
AAANAADGGA IKRIMFERAE KAAIEYSMAL DTAEGPSKSQ VMAHKAFDKL VYSKIRAAVG
GDVQYAITGG SAMGQELLHF FRGVGMTIYE GYGLTESAAA AAVDFTDQKI GTVGKPMGGM
TIKINEDGEI MLKGEMLFQG YWNNPEATAE ALHDGWFNTG DLGELLESGH LVITGRKKDL
IVTAGGKNVS PGPMEDIIRA HPLVSQAMVV GDGKPFVGLL VTLDPDMLKR WKLNHNIAES
RTVSEIATDP ALRAEIQDAV NNANATVSHS EAIKRFYILD RDLTEEADEL TPTLKVKRNV
VVRRYADAID HIYNR

> RXA00899 (1-1266, translated) 422 residues
MEDVHDDVPD IPTGMDVSAE VESVIKLNRR LTRMPAVTGG NNGFYSDYRE SLKRMTAAID
EAEEYIYVEI YIMAWDSYTQ PFFAALERAH NRGVKVRLLF DHVGSWKYPG YHRLKKELNR
MGFAWYLMLP LQPWRRRFRR PDLRNHRKML IIDGHTAFMG SQNLIAPSYL QKKNIKLGRE
WKDLMVELTG PIVSSMEMIF AGDWYVESNE ALDIRDHAEA HGYIGNTQKD SATNLVQLIP
SGPGYTTEPN LRMFNSIVHH AKERLILCSP YFIPDESLLE AVTSACYRGV TVELFVSEQA
DQFAIDHAQS SYYQALLEAG VKIYQFPKPD VLHTKYMIAD PDDTTGNEAL GVLGSSNLDI
RSFGLNYEIS LMIAKGNLIH ELNALTDRYR TVSFKLTLDK WNQRSWRRRY VDNVMRLTSA
LQ > RXA00902 (1-1233, translated) 411 residues
MSSGFEYVQH PRRALPPPIP ERKGPAAAFL PGTFHPINPK NIAASHDQVL LSGWGKFVRW
LLVLLSILVI IIGINLILDG VYGFGTFSTT QMYQVAKDPL IGVLIGILAT ALVQSSTTTT
TLTVTAVGTG IVSVPVAIPI ILGANIGTTI TAMLVAFSYV GERREFKRAF TVAAMHVWFN
VLVILVLFVV ELLFHPFRTI SGAIATEITL TTGGSLPTSG VMTKIFDPPT QLLGMNGLIG
SIGNPSISAI VCLVVGTILI LISVRAMSSQ IRTITAATVT SIMDKVINPE NSPKATILSN
FWSFILGVLF TLMVTASSVT VASMQPVAAS GVVKQKPLLG VILGANVGTT VTAMFATFAI
VSDQGEFAIQ AALIHLIVNF TGALLVLCIP QLANVIIHLA EKTANLTARS Y > RXA00931 (1-846, translated) 282 residues
VKTIEDILTL EEIDRDIYRG PVIESYLART FGGQVAAQAL VAATHTVDKA FTVHSLHGYF
IAPGDPTAPA IYLVDRVRDG KSYVTRSVRG IQDGEVIFSM QASFHRGDEG IEHMDKMRKV
PAPDEIKGTV ERMPISSRRV LDEWAEWDIR VIPQDQLELS DFTATEQAVV IRCTADLPDN
PTFHQCSLTY LSDMTLLHSA LVPHPGEKMQ MASLDHAVWF LRPFRVDEWL LYDQRSPSAS
SGRALTHGRL FNQQGDLVAI VNQEGMTRTL HEGAQSIPMR KD > RXA00941 (1-1317, translated) 439 residues
MNLTRNDRLD RLPVTSKHKK ILGGSGIGWA LDAMDVGLIS FVMAALATHW GLSPTETSLL
GSIGFVGMAI GASLGGLLAD KLGRRQVFAL SLLVYGVATG ASALSVSLAM LMALRFVVGL
GLGAELPVAS TLISEFSPRK VRGRMVVILE AFWALGWIMA AIVGTFVVAG SDNGWRWALA
LGCVPAIYAV YVRLGLPESV RFLEKKGRHD EAEAIVVSFE EAAAAEGKAA DATTAVVHDN
AAEGSVSIWS AALRKRTVAL WIVWFCINLS YYGAFIWIPS LLVADGFTLV KSFQFTLIIT
LAQLPGYAVA AWLIEKWGRR STLATFLVGS AISAALYGLA NVEWQILVAG CLLSFFNLGA
WGALYAIGPE LYPTNVRGTG TGAAAGFGRI ASIIAPLIVP PVIAFGGPIA LFALFATAFA
IAAIAAFTLP EQKGKSLAD > RXA00962 (1-666, translated) 222 residues
DKAIKADHDI REGHDEPAGF KDLLVDRYRW ISIWFALATF VTLLAWYGLG TWLPRLMETA
GYEFGHALMF TLALNLGAVI GSVVTAWAGD RFGPIRSGVI AAGIAGIALL LLLTYPPVTA
VYVILILAGV GTHGTQILII AAVANFYPSN LRGTALGWAL GVGRIGAVVA PQLAGLLLAW
NLGVNSNFIM FGTAALLSAL ALSVLLRLQK TYSVTHKVEI QG > RXA01060 (1-924, translated) 308 residues
MNRTLRTLGW LAAVIQEDPE PWFTTDPDTD YVPYVNSFSF ESLSLVPDAL MLLKRSLHLA
MEQQDLPVKD LQEALRHVLV FKFHFREEWE LELAWDSERT KSAVRIIEST KESLADQYRD
YKYAFLPELI FQESRGIFDF ELEGYTLKVG QSTLSIPWDM IANGYVPASL RNFGELMDRD
TGDLDADPIL RPRELKFEIH NCPDLNPWIM RETFDFMMEI ATETGWFHAL NPAYNSVYTY
DLISRMPDFL VEGSFRPHSV KRSWEKIQKI AKAVESYASH DYCMSTLTHD YRAIELSLTP
TKTEEPST > RXA01067 (1-729, translated) 243 residues
VSEFQVPEIP AQFLPKHIAL VMDGNGRWAT ERGMKRTEGH KRGEAVLLDV VDACIELGVP
```

```
YLSAYAFSTE NWRRSTDEVR FLMGFNRDVL RRQRDDLHEK GVRVRWVGRR PRLWRSVIRE
LETAEELTKD NTTMTLAMCV NYGGRAEIID AARDIARLAA EGKLRPEQIT EKTFPNFLDE
PDMPDVDLFL RPSGEKRTSN FLLWQSAYAE MVYQDKLFPD FTQQDLYDAV LEYAKRDRRF
GSA

> RXA01114 (1-792, translated) 264 residues
RLAEARETAG GRNHPIPGGM IETAENLRRE YGISREEQDK ISAASQQRWG KAADAGLFDD
EIVPVTVPAK KRGQEPTIVS RDEHGRPGTT VEKLAALRPI MGRQDAEATV TAGNASGQND
GAAAVIVTTR AKAEEKGLRP VMRLAGWSVA AVPPETMGIG PVPATKKVLD RLGLTLEDIG
AIELNEAFAA QALSVLKEWN ISWEDERVNP LGSGISMGHP VGATGARMAV TLAHRMQREN
TQYGLATMCI GGGQGLAAVF EKEN > RXA01136 (1-432, translated) 144 residues
MTLDYFKASG TDYALGLAAE SEGARRTGIT GMASAFKEFA GCGEIDLEAT RVEGGLKVSG
KLRWASNLCE DPVIVPAAKT AEGLQLLFAL GAETEGVTLG SSLALLGLNA TACAWVSFED
VFIPGAQILS HDFLTLWHRC AQPS > RXA01138 (1-417, translated) 139 residues
VVTTTDGEVD HGLTVSAFVS LSLEPAMVLV SIDKKSSVVP FLEQGSPVAV SVLSEEQSDL
AITFGRHLEN KFDGVSIKRS TNRAAVLEGA SAWLSGAVVD KYPGGDHFII TIAVEECAHD
EEQKPLLYHR GRLFQWQED > RXA01172 (1-1455, translated) 485 residues
VLASFRFAFS SPRRFRTEVL AGLVVALALI PESIAFSVLA GVDPKMGLFA SCTMAMTIAL
TGGRPAMISA ATGAVALVIA PVVRDHGVEY FLATVILAGI IQIALSLLGV AKLMRFIPRS
VMLGFVNALA CLVFFAQLPH LIDVPWMVYP LFALGIGIML FWPKLTSVIP APLIVIVALT
AIVWVFGINI PNVSDQGELP SSLPEFLIPN VPLTLETLKI IGPYALGMSL VGLMESLLTA
KLVDDITEVH SNKSREAAGQ GIANIITAFL GGMGGCAMIG QTMINVKNSG ARTRLSTFLA
GGFLLLLVVL LGDVVGKIPM AALVAVMIIV SIDTADWHSL NPRTLKFMPL SETIVMFITI
IATLVTGNLA IGVILGVLTA MVMFARRVAH LVSVERTTDN NISTYTVKGQ LFWASSNDMV
YSFDYSDEAE QIIIDLTAAE IWDASTVATL DSIIHKYAAR GKSVEIIGLD GPSRDRLERL
SGKLG > RXA01191 (1-1407, translated) 469 residues
VSLDANTIET AGRGDVISRI ADDSREVSTA ASTVVPLMVQ AGFTVVISAF GMAAVDWRLG
LVGLVAIPLY WTTLRVYLPR SGPLYTRERE AFGVRTQRLV GAVEGAETLR AFRAEDTELK
RIDAASGEAR DISISVFRFL TWAFSRNNRA ECITLVLILG TGFYLVNIDL VTVGAVSTAA
LIFHRLFGPI GTLVGMFSDI QSASASLIRM VGVINAASNQ VSGTSPASAS TALTLFDVSH
HYHTAPVIKN ASVQLEPGEH IAIVGATGAG KSTLALIAEG LLSPTSGQVA LGGSSFSNVE
PEALRQKIAM VSQEIHCFRG SVLDNLRIAR PEATDADIHA VLADIGDSWL ERLPQGIDTI
VGDGAFRLTS VENQIMALAR VHLADLAIVI LDEATAESGS DHAKQLEDAA LKVTENRSAI
IVAHRLNQAK TADRIIVMDS GEIIESGTHE ELRAIGGRYE QLWTAWSAR > RXA01205 (1-531, translated) 177 residues
VSAYPPAIIA AALVGICAGV LPHNFEPSRI FMGDSGSMLI GLLLAAASTS ASGKINMSLY
GAADFIALIS PIIVVLAAVA IPLLDLVMAV VRRVGRGASP FSPDKMHLHH RLLSIGHTHR
RVVLVLYTWA SAVAFGAVSF SVVPPLFATG SSICGILIAV AVTAVPVMKS RRAAKLD > RXA01212 (1-813, translated) 271 residues
GLNFHVQRGE VFGLLGTNGA GKTSTLEVIE GLSAPSSGTV RISGLDPVAD RAILRPELGI
MLQSGGLPSQ LTVAETMDMW HGTCTYPRAI KDVLADVDLL HRENVKVGAL SGGEQRRLDL
ACALLGDPSI LFLDEPTTGL DPESRRHTWQ LLLDLKQRGV TMMLTTHYLE EAEFLCDRIA
IMNAGEIAVE GTLDELVARE KSIISFVLRG GQVELPVLSG AEIIRDNNHV RIATTTLQQH
TLEILTWAAE TGIALEGFAA KPATLESVFM D > RXA01219 (1-882, translated) 294 residues
MDILLNQLVA GLSVGSVLLL VAVGLSLTFG QMGVINMAHG EFIMVGAYTA YVVQLVVGSA
GLSLLISIPL AFIIGGLFGV LLEQFLLKYL YHRPLDTLLA TFGVGLILQQ LARNIFGAPA
VDVRAPEFLR GNVEVLGVLV PTARLFILAL AIASVTALAV FLNRTAWGRR IRAVVLNRDL
AETAGIDTRA TDRMTFFVGS GLAGIAGVAI TLIGATGPTI GQNYIVDAFL VVAAGGIGRV
KGAVIMAFVL GITQAFVEYT TGASIAKFIV LIAVVAFLQF RPQGLFQTQT RSLV
```

Appendix B, page 10

```
> RXA01220 (1-1077, translated) 359 residues
MSTQLKLKKP AKKKTTPKLS VVNAPTLRTA ALGLAALAAV LLCAPLFLST FQLTLMSRLV
CYAIVAVGIG LAWGRGGMLT LGQGVFFGIG AYIMAMHMLY SDSQIFGTTV PQWWSIFANP
AVALIAVVAL PGIVAFVLGF SIFKRRIKGA YFAIVNQALA AAVVVLLVGQ QDSLGGSNGL
SGFRSFMGFA VYDPINRIMF YFTAVGVLLA LVAISYWLMR SRYGELLVAT RDAEERVRFL
GYDPALIKTA AYVIAAMIAG IAGALFVPIV GIISPAEIGV VPSIVFVIAV AAGGRASLFG
PVVGALVLGW VESTLAQTFP SMWSYFQGAI LVLVIVLLPG GIASIKLSAL KNKARKATS > RXA01221 (1-726, translated) 242 residues
MSLKITNLKV AFGSFIAVNE ISFQVLPGHV HFLIGANGAG KTTCIDAISG LAPGQGSVQL
DGTEILGTPV HRIARMGVGR TFQTASVFEE LSVLQNLDIA CGIHRPLRAL LGVRHRIDPR
IEHALEVTGL ADLVNAQAGT LSHGQKQWLE IAMLLVQDAQ VLMLDEPVAG MSEEERVATG
ELLQRVARGR VVLVVEHDME FMRRFATRVT VMNRGTILCE GSVDEIQANP DVQSIYLGTA
GK > RXA01222 (1-699, translated) 233 residues
MLEITNLCAG YGRTQVLHSL SISTSSNGIL SILGHNGAGK STLLRTAVGL IKPTSGEVKL
FGQDVTSLST HERVKRGMAY VPQGQQSFTQ LSCMENLQVV ADLQGRVGKA RIAEALDRFP
ALTQVLDRQA GLLSGGQRQQ LAIARALITA PKLLLLDEPT EGIQPSVVAE IQQTIIDLAK
DGMSIVLVEQ NIGFALDAAT SYAIVARGQV VESGQGAETT AEKQTKVRES LAI > RXA01235 (1-972, translated) 324 residues
VVLFSGFSGV IDLSPTAVIR HLSGQDTLTP RDQAIFFDIR LPRIIAGVIV GATLAISGAA
YQAVFRNPLA DPYLLGVSAG SGLGVTAVIV GGTVLGFSAP SIGVIGAAFV GGVAAVLATL
MVSRGVGQGS STTVVILAGV AVAAFASSIQ TYIQQRHIDT VARVYVWMLG NLNVTNWMSI
FIVAVVAGLC AAVIMSCARL LDVMAVGDVE ARTLGVDPGL VRIGIVIVAT LGTAAVVSIS
GLIGFVGIIV PHALRLIVGP GHRILLPLSF VWGAIFLVLA DTAGRTLMAP QELPVGVVTA
ALGAPFFLFI LRRTSRQRVP KRSA > RXA01260 (1-1182, translated) 394 residues
VTFNYEDAHK RSRGVSDKIV GGVHYLMKKN KIIEIHGLGN FKDAKTLEVT DGKDAGKTIT
FDDCIIATGS VVNTLRGVDF SENVVSFEEQ ILNPVAPKKM VIVGAGAIGM EFAYVLGNYG
VDVTVIEFMD RVLPNEDAEV SKVIAKAYKK MGVKLLPGHA TTAVRDNGDF VEVDYQKKGS
DKTETLTVDR VMVSVGFRPR VEGFGLENTG VKLTERGAIE IDDYMRTNVD GIYAIGDVTA
KLQLAHVAEA QGIVAAETIA GAETQTLGDY MMMPRATFCN PQVSSFGYTE EQAKEKWPDR
EIKVASFPFS ANGKAVGLAE TDGFAKIVAD AEFGELLGAH LVGANASELI NELVLAQNWD
LTTEEISRSV HIHPTLSEAV KEAAHGISGH MINF > RXA01261 (1-171, translated) 57 residues
VTEHYDVVVL GAGPGGYVSA IRAAQLGKKV AVIEKQYWGG VCLNVGCIPS KVSDQKR > RXA01269 (1-441, translated) 147 residues
VVFEMIKFRT MLEPDEKHVT DEQRLTKVGK LLRETSLDEL PTLWNVFKGD MSLVGPRPLL
VSYLEHYSSE QARRHEVRPG ITGLAQVNGR NQTTWDERLK LDVEYVDRCS LKLDFKILIA
TVKTVLSKKG ISNEGHVTMP SFIEERK > RXA01291 (1-933, translated) 311 residues
VADQQDFLGR FDAMSSKATA TVIAHYSSSF TLASKLLSPK IRRDIEALYA MVRVADEVVD
GAAAAAGCAP DAVAEILDNY ERQVLLSLSV PFHTDPVIHA FGNTARKCGF EQAHIVAFFD
SMRRDLSQTS YDPTQLDEYI YGSAEVIGLM CLKIFLQDST ASPQDRATME HGARRLGAAF
QKVNFLRDLA EDREGLGRSY LPVFTEEMRD EIVTDIREDL DAARLSIPLL PFGARTGVRA
ATDLYGCLVD NLESASLEDL KNGRDFVPSL KKPAWQPKQC GKKCFKNDKS SGHRRGTSRT
SHHRTALTRR I > RXA01292 (1-1185, translated) 395 residues
MTKAVVIGGG LAGLATTALL LREGYEVHLV EQNEHLGGRA GTFELDGFRW DTGPSWYLMP
DAMSHFFKLC GTSIDDHLDL VPLEPAYRVI DDHGEFIDVT SDIDAMAELF ESREPGAGAK
LRTYIDSATQ VYNLAIDGFL YTNFTNFIPY LSPGMLRLLP KLLASLSTSL KVKVNTQFRD
TKLRQILSYP AVFLSSDPSH TPALYHLMSH TDLVQGVSYP RGGFTAFIKA LISLIDDAVL
HLGTPVSAIT TQGRNATGVQ VGSEFIEADI VISCADQHHT ETQLLPASLC AKPETSWKNK
```

Appendix B, page 11

Attorney Docket No.: BGI-125CP

```
QPGLSTVLVL AGVKGEHTLL FPPTGTKISA KFSTAPPQNS RLQNPSRSPR PPQQIPMPHP
KATRTSSSWS QYPPMSPLVT GPLTEKNLTW WAGSQ

> RXA01293 (1-327, translated) 109 residues
MVGRIAIAAV AQIGRWAGID GLESRIVVQR TIGPADFADR YNSWSGGSIG PSHTLAQSAF
FRGSNKSRKV DGLYDAGDTT VPGVGVSMCL ISAENVLKRL RGDNSVDRT > RXA01339 (1-1245, translated) 415 residues
MTTESIVAHN AAGTAPQNVS SAKKKYLSVA QGVALIYGTN IGAGVLSLPY AARNGGFLAL
VVALLIAGTL TTISMLYIAE VSLRTKKPLQ LSGLAEKYLG QWGRWLVFIA IVVNSVGALI
AYASGSGILI GNLTGLPPIV GTLGFFVLGT LIMWKGLHTA SFVEALITTG MATIIIVLCG
WTVLGPGISA DNLIVFHPFF IVPIMNLAVF TFLAQYVVPE IARGVNPATP KAVPRAIIIG
MVATGVTLAA VPFAALGLLG TGVSEVVTIS WGEALAPVAY YMANAFALLA MFTSFIAIGF
TAMRNVLDIG HWPQHGWQRS VAVGLTVLPP LAISLAGLGG FVAALSYAGG FAGAIMSIIP
VLLLRNSRKS GDQEPVWKAT WQAHPIFQIL LIVVYSLAFV YSVLAIVGLM PAGWA > RXA01382 (1-1062, translated) 354 residues
STSTAAGTGT ANEEGTITAA ISYELGTNGY DPMTTTSALT VAANWHTLEG LTEIDPATGE
VYAALASALP SADATSLDIK LRDGATFHNG DAVTADDVVF SFERVLDPAN NSLYASFIPF
IKSVTKKDDT TVTIDLDYAT GIISERLAVV KIVPKSVVEA DASGFDANPI GSGPYKMTDN
GASKVVKFER NDDYNGPRPA RAAKMEWQII PDASTRTNSL QSGSTMAIDS VPYLSIPQLE
ATSTVESVQG FGLLFAMFSC SEGNPFNDVR NRQAFLYALD MDKIVKTGMS DQATPATSFV
QKEHPNYNQA STVYSLDADK AKALFAETGL TSLNLLCTDH DWVKNCTPLI QESL > RXA01399 (1-1119, translated) 373 residues
ILSPATALVL AIGLIAAAII PPLLAARGVK TAEARRAESS EAYLSSLDQV LSNQAALRVR
GEMPAALSKA DVAARSYSSS LEAGAKDTAI GAASSLWIHG FTVIGVLMVS ASLYADGSHS
PQWFGVLVLL SLAAFEAVSV LPDAAIARTR AADATRRLAE ISALPESVSL ELRTASDQPV
LRAENLVYGW DSDLGTSNLD LTFGSRHEII APSGTGKTTL LLTLAGLLEP RGGQVLIDGT
NPSELKNAVL FSPEDAHIFA TTVRDNLALG APEATDAEMT SILEHVGLSE WVQGLPDGLG
TVLDSGADSL SGGQRRRLLL ARVLLSDAPI LLLDEPTEHL DTAGSSEILS MLASDELPGK
RARRTVVIVR HVR > RXA01419 (1-264, translated) 88 residues
MLLSARTHTS FQELGLNASR RKAINWTLAL TVVLIASMFV GVLIGASGTS VFSTWTVISH
HLFGTELGGS DTADAIIWYI RTPRVLLA > RXA01420 (1-759, translated) 253 residues
VTLGGLNVPS WSLGAEMLFY LTFPLFIPLV RKVKGVGNWW AFGITFAVSL ALITVIHFYA
DGPKGIENFF VPRLWDTNVS PVAEVHADPV WFMQEEIPVL ESYWLSYYFP LTRLIEFYLG
VFGAKLVAEG MFKNTNITIP LIALAVSFVA TWFVPLAFKM SVIMSLPMAF VVATLAVRDI
EGKSGEIASP RAVLLGNISF AFYMVQFPVM VFVQRYFIAG KEYGFLGWAF YAVVCFIVSV
ILAWVLLPSL MIL > RXA01467 (1-291, translated) 97 residues
MDFNDKAASE NAVKTGAEGP NVFASVAKIL QDVGGISAED VTPESRFTED LAVSSLNYIE
LIVNAEDAFG VRIEDADAKD LTTVQDLIDF INTNKAD > RXA01538 (1-390, translated) 130 residues
MADNKNADDS QLVSASTGTP GPGDIAKANA PSLKQAAVTA SGRSALMGAI FLMATSAIGP
GFLTQTAVFT NQLGAAFAFA ILVSILIDIA VQLNVWRIIG VSEMRAQELG NTVIPGFGWV
LAVLVCIGGV > RXA01576 (1-759, translated) 253 residues
VAPNRKISHH ALGSIPIMDA SKNSDFKDTW LVVPCYNEAT VIREVLENAL KTFPNIVAVN
DGSPDNSAEE IHAAGAHLVN HPVNLGQGAA IQTGIEYARK QPGAKYFVTF DADGQHQVKD
VIRMVERLRA EDVDIIVGTR FGRPRQADDQ VPLIKRLVLR TVVLLSPKTR RLGLTDAHNG
LRVFNQKVAQ EMNIRMNGMS HASEIVDQID ERGWRISEEP VDILYTEYSM SKGQSLLNGV
NILADGFLAR RLP > RXA01580 (1-702, translated) 234 residues
```

Appendix B, page 12

Attorney Docket No.: BGI-125CP

```
MYKNMHIVAH RGAEDLHLEN TMTAFQAAAP ADAFELDIHA TADNQVVVIH DRTAARVAAP
DSLHRDTPVA RLSAAQIKEI TLIDGSPVPT LEEVLLQTSL PIQVEIKSAG AVPAAAALLQ
KYPEHLERLL FISFIDAALV EIVDRLPEAR VGILRDASMD DLRILDYIPL KNVGAILPSW
KALNVASIAD LHTKGIKVGC WTIRDENAFG IAQQAGVDYP TVSDPSRFSR PPLL

> RXA01584 (1-543, translated) 181 residues
VVFLGALLGA VIMGGFYPAF IQAGSTVFGG GHVVLPLLEK LVVAPGFIKE TDFLSGYSAA
QAVPGPMFSF ASYLGAIYGG IGGAVLASLA IFFPAALLSI SGMYFWGRWR KAPRIQAAVT
GINAGVVGLL GAALYDPVFT HGITSVSALA IATVCWLGLA HWKIPPWAIA AGAALAGWVL
L > RXA01591 (1-945, translated) 315 residues
ASLNWSVIVP ALVIVLATVV WGIGFKDSFT TFASSALSAV VDNLGWAFIL FGTVFVFFIV
VIAASKFGTI RLGRIDEAPE FRTVSWISMM FAAGMGIGLM FYGTTEPLTF YRNGVPGHDE
HNVGVAMSTT MFHWTLHPWA IYAIVGLAIA YSTFRVGRKQ LLSSAFVPLI GEKGAEGWLG
KLIDILAIIA TVFGTACSLG LGALQIGAGL SAANIIEDPS DWTIVGIVSV LTLAFIFSAI
SGVGKGIQYL SNANMVLAAL LAIFVFVVGP TVSILNLLPG SIVNYLSNFF QMVGRTAMSA
DGTPGEWLGG CTIFY > RXA01604 (1-606, translated) 202 residues
DTPFADVEIA PDSGLTLLST GRESQSSSFS LVLSGRMRAS TGTIELNGEP IKATKLAKHV
ALAGIPEIDS LERLVTVRTV VREQLAWSSP WYLMVPRDIS DSGRWVDVEK HLGLNLNPKT
LIGDLSVLER FKLRIALALL ARPEAQLLVV DDPDQVRSME LRAEVLHALK GVAEDLPVVV
VSTNPDFDSL ADTALTITGA GN > RXA01614 (1-1023, translated) 341 residues
MNQMQQWKPD FLGEGYQNLT IELGDDPDNE TDVVTTVVRY NPDNHADESF AARPALLWVH
GMTDYFFHTE FAEFFHNAGF AVYGIDLRKC GRSYRPGQQW HYTSDLAHYF PDLTAAAEVI
SSTHPELVPV AHSTGGLIVP LWMSQMRTSN PAAIEKIPAL VLNSPWLDMM YPPLFIKLIT
PMVRVLGKRS PTTIIPGGGL GAYGKSIHKN FYGEWDFDTT IKPVEGHKKS IGWLRAVMAG
QAEIHHDHVN VGVDVLTLCS NKSWLKSEYT EDTNTSDAVL DVKHIQKWAP HLSSPSSRVD
VEIIDNARHD IFLSRKPARD HASEVLNNWL QSKLSSLKPS Q > RXA01629 (1-1512, translated) 504 residues
VSPIRSKKKI KNEPRLTVDD VNVVPPKKIR PAIKGTVVGN FMEWYDFGIY GYLTVTMTAV
FTQGLPQEWQ LLAVMFGFAV SYLVRPLGGL VLGPLGDKVG RQKVLYVTMA MMAVSTALIG
LLPTAASIGA WALVLLYLLK MVQGFSTGGE YAGATTYVAE FAPDRRRGFF GAFLDMGSYL
GFAAGASVVA ITTWVTTHFY GATAMEDFGW RIPFLTAIPL GIIAVYLRTR IPETPAFENN
QDEPNAVVEK DTEDPYARLG LAGVIRHHWR PLLIGIAIVA ATNTAGYALT SYMPVYLEEQ
IGLHSASAAA VTVPILVVMS LLLPFVGMWS DRVGRKPVYA TAVAATLILM VPAFLIMNTG
TIGAVLIALS MVAIPTGLYV ALSASALPAL FPTASRFSGM GISYNISVSL FGGTTPLITQ
FLLQKTGLDI VPALYIMFFS AIAGVALLFM TESSQKPLLG SFPTVETKSE AVEIVKNQDE
DPNIDLSHMP FPDEENVGAE KQNA > RXA01644 (1-1278, translated) 426 residues
MTIADIVEAT TTAPIPFHIT AFDGSFTGPE DAPYQLFVAN TDAVSYIATA PGDLGLARAY
LMGDLIVEGE HPGHPYGIFD ALKEFYRCFK RPDASTTLQI MWTLRKMNAL KFQEIPPMEQ
APAWRKALIN GLASRHSKSR DKKAISYHYD VGNEFYSLFL DDSMTYTCAY YPTPESSLEE
AQENKYRLIF EKLRLKEGDR LLDVGCGWGG MVRYAAKHGV KAIGVTLSEQ QYEWGQAEIK
RQGLEDLAEI RFMDYRDVPE TGFDAISAIG IIEHIGVNNY PDYFELLSSK LKTGGLMLNH
SITYPDNRPR HAGAFIDRYI FPDGELTGSS TLIKHMQDNG FEVLHEENLR FDYQRTLHAW
CENLKENWEE AVELAGEPTA RLFGLYMAGS EWGFAHNIVQ LHQVLGVKLD EQGSRGEVPE
RMWWTI > RXA01667 (1-1206, translated) 402 residues
MILGPKVLGL IGWSDHLSTY TTVLIAIVFA SMPYSMKFDR GVRTGMKTMW AYSTAMFVGQ
WGLFILLGLF LFQPVWGTDE WFGMMLPVGF VGGFGTAAAV GTALESSGAE AAMSLGFTSA
TVGTFAAIVG GIIFTTWGIK KGKTAAMPAQ LPWDLRSGYI DKLSDRPSIG KASTNPSAIE
PLALHTGIIL LTVAVAYSIN QWLGSMFPTV QIPLFAMSFV VGIVGMGIMR LLKKPEYLDR
DTVNSVSGAA TDYLIAFGIA SIAPAAIADY WVPLVVLFVL GTINCCFFFF WVAPRFFGEK
WLERAIFGWG WATAAVATGI ALLKIVDPKL KSGALNEYGV AYIGFAPFEI GMTIIAPIAV
```

Appendix B, page 13

Attorney Docket No.: BGI-125CP

```
LAGFTMGLGW ASLIVAIVIF GLAWGLKWLP ERGHVRGEGK PQ

> RXA01722 (1-1725, translated) 575 residues
MLSTMQDVPL SLTRILEYGS TVHGDTLITT WGGADGIEQA QQTFSAVGAR AAALAHALHD
SLGITGDQRV ASMLYNCAEH METMFAVACM GAVFNPLNKQ LMNDQIVFIL NHSEAEVVIA
DPRMAEQLGE ILKETPKVRA VVFIGPNDFS SAAAHMPEGM KLYSYEALLD GRSTVYNWPE
QDERTAAAIC YSTGTSGPPK GVVYSHRSLY LQSLSLRTTD SLAVEHGETF LCCVPIYHVL
SWGVPIAAFM SGTPLVLPGP DLSAPTLAKI ISTTLPRVAH GVPTLWIQLM VHYLKNPPER
MSLRELYVGG SAVPPIVITM WEQRYGVDVV HVWGMTETST VGTVSRPPSG VSGESRWNYR
VSQGRFPASL QYRIVNDGQV MASTDRNEGE IQVRGPWVTA SYFHPDVEKE GGTASTFRDH
DVEEENDELF TADGWLRTGD VGSVTSDGFL TIQDRARDVI RSGGEWIYSA QLENLIVAXE
EVVECAVIGF PDDKWVERPL AVTMLYPGIE RTRETAERLR DQLRDRLPNW MLPEYWTFVD
EVDKTSVGKY DKKDLRNHLR NGDFEVIKLK GPGXK > RXA01727 (1-1278, translated) 426 residues
MSKKSVLITS LMLFSMFFGA GNLIFPPMLG LSAGTNYLPA ILGFLATSVL LPVLAIIAVV
LSGENVKDMA SRGGKIFGLV FPIAAYLSIG AFYALPRTGA VSYSTAVGVD NALYSGLFNF
VFFAVALALS WNPNGIADKL GKWLTPALLT LIVVLVVLSV AKLDGTPGEP SSAYAQQPAG
AGLLEGYMTM DAIAALAFGI VVISAFKYQK VNKVRTATVV SAFIAGILLA LVYLGLGSIG
QVVNGEFADG TAILNYAALS TMGQAGRIMF VAILILACMT TAVGLISATS EFFNSLLPGV
KYHVWATVFA LISFGVATMG LDTVLAVAAP VISFIYPSAI TLVFLSLIEP LLFRLKWTYL
FGIWTAVVWA LFMSIPALNP FIEWAPLHSM SLGWVVPVLV ASAIGLAIDW NKKGAQSVAK
KESISV > RXA01737 (1-1059, translated) 353 residues
MGRMKNDGEL ADLPDHALLS IIRIPQAAKR SPWALILTRI GYAMVLLVIV TMVVYFDRNG
YSEDLTFIDA LYYSTVSLTT VGYGDITPVT QSARLINIIV LTPARIGFLI LLVGTTLSVL
TEESRRALQI QRWKRMRNH TVVVGYGTKG RSAVAALLGD GVPANQIVVI DTDQVSLDAA
NNSGLVTVKG SATKADVLRL AGVSRARAVV VAPNLDDTAV LVTLSVREIA PQAMIVASVR
ESENQHLLEQ SGADSVVISS ETAGRMLGLA TVTPSVVEMM EDLLSPDEGF SVAERLVGED
EIGSNPRHLA DIVLGVVRSG ELYRIDSPEA ETVEPGDRLL YVRRVFSEEV NDK > RXA01755 (1-348, translated) 116 residues
MSTPDIKEGS AESPGEVMVV GDRREWRRQA TGIIAGLVLA ALVYLLFPSN SVETVMQSSG
VDPETEYTNN AMRLTAAVTI LMAVWWMTEA IPLAATALIP LVAFPAFQVV DFGKAA > RXA01762 (1-1263, translated) 421 residues
MKVNLGIGSY PRRRATVRPE STAIEFEGTS ITYGEFSKRV NRLGHALLDL GVAHQDRVAY
VGFNHPALLE VFFSTNLIGA TPVLVNPRLS ANEIDYIIQD SGASIVFYGI DLIEHATYLQ
ELHPEIIMVA VEGDEGPGLR RKALIEAASD ADIDLEVSDD DLVLLMYTSG TTGRPKGAML
SHRNLFFNYF NALLSQEIEQ GAVLLSTAPL FHIAGLNMTT IPVMMKGGKV IIHREFRAEH
VLDEIERSKV SESFMVPAMI DMLSNHPSFA ERDLSSLRAI MVGGSPLSER ALRIWQGRDV
KIVQGFGMTE TAPGACILEA TDTSTHLGTA GRAHFFTDIK LVDPKTGEEV PTGEAGEVLI
RGPHVMTGYW NRPEDTASAL QNGWYHSGDI AIKDEDGYYT IKDRIKDMYI SGGENIYPAE
V > RXA01764 (1-933, translated) 311 residues
MSLNGKVAIV TGSGAGLGRS FAQELARQGA SVIVNDVNQA AADETVAAIT EAGGKAAAVI
APVGPSESAA LLVREAVDKF GSLDILVTNA GILRDRSLLK MTDDDFDAVI NVHLKGTFTC
VREAFGYFKE NGIAGRIVTI GSPTGQRGNF GQSNYAAAKA GIVGMVRTWA LEMKRAGVTI
NAIIPEAATD MTKTVPYFQK AVEADERGEA MPAFFRETLG FGTPQDVAGL VAFLSSDEAA
NISGQAIGAG GDRMQVWKHP EPAVTEFNPG GWTYEALQER GKNIIEGNLQ SVGVVFPELP
AELQPQIPVK A > RXA01766 (1-291, translated) 97 residues
MRDPIQGAVI PSDLFGFAEV LTEAERAVLL ETRRVLEEEV KPYINEAWDK AVFPDEIVQP
LQDLQLLDPP ALREAGESVR DIFTGFRNFE LARCDIN > RXA01801 (1-1017, translated) 339 residues
MSNVVNTFVQ NSTGMVELNR PKALNSLNQE MIDLVQEALT TWADDDQVQQ VLIYSSSERA
FCAGGDVRAV RESVLEGDVA AGDKYFIDEF AMNNTLGTYP KPVISVINGV AMGGGMGISM
```

Appendix B, page 14

Attorney Docket No.: BGI-125CP

```
HGSHRIVTEK AFASMPEMAI GYVPDVGFTY FGQRASSLAI ATFLAVTGWR MSPADMLWAG
VATHFVEDAQ GFIDAVLNES LDGALEKFST QPTGSSELAG VASQIEETFG HSSWALIDAS
LRSHPDAEFV AKVDGLMASA APASVVATVK LMHQNSEATT LREGLDNELA MSLYMIRQPD
FAEGVRAVLV DKDRNAAFSP ANYEDVDESH FVTLFQRSS

> RXA01823 (1-777, translated) 259 residues
MLQAHDLTLS YGGRNIVEGL SLDLPERGLS IIIGPNGCGK STVLKALGRL LKPQLGKITL
GGRDISSMGT KHVAKHIGVL PQPPYAPDGV SVTELVSRGR YPHQHLLSQW SKDDEAIVAR
SLAEVGMHTH AEHLVSELSG GQRQRAWIAM ALAQETDILL LDEPTTFLDV AHQISVLDLC
SDLHQRGRTL AIVLHDLNMA ARYATHIIAM RDGTIIDQGK PEEILTKALL KEVFDLDALI
LKDPNNGRPL IVPTDRRNS > RXA01833 (1-1407, translated) 469 residues
MLFERIYEEG LAQASYFIGC QREGKAIVVD ARRDIQTYLD LAAKNNMVIS AVTETHIHAD
YLSGTRELAA ATGAEIFLSG EGGADWQYGF TGTTLMHNST IKLENITITA KHTPGHTPEH
LSFLITDGAV SKDPGFMLSG DFVFVGDVGR PDLLDEAAGG VDTRFAGAQQ LFHSLKEQFL
ALPDHIQVYP GHGAGSPCGK ALGAIPSTTV GYEKANAWWA PYLRSDDEAG FVEELLDGQP
DAHAYFARMK KQNKQGPAVL STLSPLVKLE AEEVVEKLGS EAVFVDTREQ NQVHLGTVVG
ALNIPRGAKA SNFAAWVIDP QKDAQDLIVL APDANTAADF RDALLRVGID TVRYFTNSID
GLPTFVPELI SPAELAETNY DALIDIRAKS EFAAGSIPGA QQLSGGSAMW RLNELPAGGT
LVTFCQSGAR NTVVANALRR AGFTVIELEG SYAAWEKSAA NPKNLQTAV > RXA01853 (1-552, translated) 184 residues
MEILGFAAGP YKTNCYVVRG ENEVAIIDPG MHAHDDLVEY ITTNNLSVDK IVLTHGHIDH
TRDAGVVAKR FNAPVYIHPD DAFFLEVYKG SGTKTAMLFD ADNMVSPDPE SLRDLVDGET
ITLAGEEFTL KHAPGHSPGC TLIVGKEYCF SGDVLFKGSI GRTDFEWSDA DAMNESLRTA
VLPL > RXA01881 (1-441, translated) 147 residues
MANLINLENV SKTWGLKTLL DGVSLGVQTG DRIGVVGLNG GGKTTLLEVL TGIEKPDQGR
VSHNSDLRMA VVTQRAELND DDTVADVVLG PLGLEVFEWA SNATVRDVLG GLGIVDLGLD
TKVGQTFSGG RSADAPTWPP RWFATLT > RXA01894 (1-855, translated) 285 residues
MPKPKNNAGR DLKAAIAVGI GLGVLVLLGI VLSPWGWYIL VAGFMAAATW EVGSRLKEGG
YHLPLPIMII GGQAIIWLSW PFGTMGILAS FVATVLVLMY FRIFYNGTEK EARNYLRDTS
VGIFVLTWIP LFGSFAAMLS LMQNNSIPGT YFILTFMLCV IASDVGGYIA GVFFGSHPMA
PLVSPKKSWE GFAGSIVLGS VTGALSVHFL LDHHWWMGVI LGCALVVCAT LGDLVESQFK
RDLGIKDMSN LLPGHGGLMD RLDGMLPAAM VTWLILSVIS SSYPS > RXA01897 (1-543, translated) 181 residues
MKIGVILGSI REGRFGQGVA DWVMEQIGAY DAPDVEFELI DLKAFNVPLL ESATVPGSAD
KQYDDPRVTA WSQAIDACDA FLFITPEYNH GVPGAFKNAY DILGNEWLNK TVGFISYGAV
EGIRVVEQWR QIVATFNMYD IRSQLSFSTF TENNNGTFAP NDRRPGELIR LLDSLLTAVR
D > RXA01946 (1-1275, translated) 425 residues
IRKYSRLEEQ FQSLGGYEAD AEAAQICDNL GLEARILDQQ LKTLSGGQRR RVELAQILFA
ATNGSGKSKT TLLLDEPTNH LDADSITWLR DFLAKHEGGL IMISHDVELL GAVCNKIWYL
DAVRSEADVY NMGFSKYVDA RALDEARRRR ERANAEKKAG ALKDQAARLG AKATKAAAAK
QMIARAERMI DNLDEIRVAD RAANIVFPEP APCGKTPLNA KGLTKMYGSL EVFAGVDLAI
DKGSRVVVLG FNGAGKTTLL KLLAGVERTD GEGGIVTGYG LKIGYFAQEH DTIDPDKSVW
QNTIEACADA DQQSLRSLLG SFMFSGEQLD QPAGTLSGGE KTRLALATLV SSRANVLLLD
EPTNNLDPIS REQVLDALRT YTGAVVLVTH DPGAVKALEP ERVIVLPDGT EDLWNDQYME
IVELA > RXA01980 (1-633, translated) 211 residues
MQIIDLSHAF APGQPHYPGD PDQEIKTVST IENDGFLMHQ YRLVGPWGTH VDAPAHFDPQ
GRTLDQIPVE ETHLPLYCLR FSRPDLCTAA DIEAFEHTHG KIEPGSFVAL HTGEWGKQG
IAPGWSIEAL EILHARGVIA IGHDLPDTDP SLEAQRWWLC RDHWQIENLT NLDKVPATGA
MIACPWPVPK DGASFPVRPI ALVPEHLSPT R
```

Appendix B, page 15

Attorney Docket No.: BGI-125CP

```
> RXA01983 (1-507, translated) 169 residues
MEGYGPTQIE KLLPAYTQVN TAGNNPATTP EQDLLGGAAT SPENYDHQLQ YAVDASPVHQ
NAAQAPPFLI MHGTGDRMVP PEQSAALHTH LVQAGRQSTL VLIEGFGHGF LNPGEVAELG
PNVRLDNGRL EREPQTNFSA QQSPGNPFEL QGLAADHEMI KRFFTLHLR > RXA02020 (1-1011, translated) 337 residues
MAKSNEGLGT GLRTRHLTMM GLGSAIGAGL FLGTGVGIRA AGPAVLLAYI IAGAIVVLVM
QMLGEMAAAR PASGSFSRYG EDAFGHWAGF SLGWLYWFML IMVMGAEMTG AAAIMGAWFG
VEPWIPSLVC VVFFAVVNLV AVRGFGEFEY WFAFIKVAVI IAFLIIGIAL IFGWLPGSTF
VGTSNFIGDH GFMPNGISGV AAGLLAVAFA FGGIEIVTIA AAESDKPREA ISLAVRAVIW
RISVFYLGSV LVITFLMPYE SINGADTAAE SPFTQILAMA NIPGTVGFME AIIVLALLSA
FNAQIYATSR LVFSMANRQD APRVFSKLST SHVPTNA > RXA02029 (1-1314, translated) 438 residues
MAEARLRHLE PIDVEEWPGV ASVPNLAFAG ARARQAEYRF AKACSNAGLV LLGNDPDLII
DHEELFSRLA ASGWLGLAES YMAGEWRSER LADVLTALLG TGFKPRGKLS GSFTLPGQAV
DAGGALPNEL IRLSSGDGMS AFGGVFASGV PTTLRTAVKS HVPGAGRNRE PASHFVDITK
ISEPVAVERE DLGEAQRRAA SFLLDGAKVK AGSHVLEFPS SGGALAILAA RRQGTVDALT
ADPAQVSSLE ETFVLAGVEE DIHIEVIPQA IPSPREWGGA YDSIVAMEKL EVVGKHGSKR
FIKAIDRMLT TGGNVAMQSL VATDQWSPVC SEAISLLKAY IWPALHYPTV DEVHQLVDRD
SSLRVVKETH FAGHYLKSVQ LQREVFEGQI REAAADGFDA VYRRMWVYHY ALIEALLRLG
CLNAVQFALT TRNRRGRR > RXA02030 (1-1386, translated) 462 residues
VTTTDHSTEL NPSDPGGQTA TLVIDKKTKR RVAAASTIGT TIEFYDFYAY AAAAVVVFPS
LFFPANDNPT VNLLASFATF GLAFVARPLG SIIFGHFGDR VGRKATLIGS LLTMGIATIL
IGLLPTYGQV GIIAPALLAL MRFCQGLGLG GEWSGAALLA GENAENTHRA RAAMWPQLGA
PFGFFLANGF MLILVGVLAH QDGDLHGAFM TWGWRLPFLS SAIMIAVGLW VRFSLEETPV
FKQAVDQGKK VKSPLKELFK TSPGPVVQAT LIMLSTYTLF YLVTTWILSY GIGNRSTGNG
LSIPYFEFLQ LQLATIVFFA IMIPVSGWLA DVWGRKNTLT LASVLLLGFG LTFNLLLDPE
TATKTTVFIF LFVGMSIMGL IFGPMSAILP ELFPTNVRYT GSGIAYNVSS ILGAAIAPFI
ATWLVSEFSV AYVGYYLIIV TAITFVAVLT MKENKNHDLR EV > RXA02073 (1-1530, translated) 510 residues
MISRLLQLAK KVWPELGAST LLRLLNQLLT AALIVFPAWV LSRKPDISLL AVAIIMALIA
LTAAVCRWGE QVCGHRAAFG LLAHMRVMLY DALVHKGSPS PIHGSGSIMS VATRDINSIE
VFFAHTIGPT VTAVLLSAGG VITLATLDPV AGLIGLLGVL IAWLIPLIGK QSSSSEATSR
GHIAQHLTED AAGRLEINSH GAQATRLNAL EVKEQQLEQV VTRQGLIVGI RQGAALLWPW
ISAVLLVALV PHVGIVAAAI ILGISPALDA VEGFARTMPT ALNSAQRYFQ IIDAPVAIAE
PDEPKPLPKG PLKLRISRVP VSAKGTVSLE VAAGEHIGII GSSGSGKSTL AKLILKLAQL
RSGTITIGGV DIAEVSSAEL RKSVTLVEQK SVLFRASVLE NLRMGNPELS EDEAREALRL
ASISELPLDA DALRLSGGQQ QRLCLARALA RTPQVLIVDE ATSHQDALNQ ADLSQTLATL
KDTTVIIIAH RTAALTHVDR IIDLEEIKNP > RXA02074 (1-1623, translated) 541 residues
MRSLLRDIPA VGWLITATIV VRTLVVALVI VGIGLLIDVP SPAHSAMLWW VLAGATAAAA
LLCAEAVLPQ RIRARVERSW RRQLAAKNLE LNSSSSDDAQ LITLATEATS KASTYTVMFL
GPYFAVFLAP LTVIAVVGAA ISWPIAGILC LGLCVIPFVI SWAQRMLKGA GAGYGRASGQ
LAGVFLESVR TLGTTMMLNA AGQRRQIITQ RAENMRSQVM SLLYRNQLMI LVTDGVFGVA
TTMVAAVFAI GGFFSGSLTL GQAVALVLLA RLLIDPINRM GRTFYTGMAG KPSLIAIEKA
LATTFTDQPT QQGQRHDGDL VVNNLKIARD HRDIVHGISF SIPRGSHIAV VGPSGAGKSS
VALALSGLLE FDGAISLGGH NCEMLDLRAS VSFVPQSPTL FSGSIKSNID LARTGVDSDH
IHAALLGEEL PADLKVGETG KGVSGGQAAR ISIARGLVKN AAVIVLDEAT AQLDYTNARQ
VRHLAKSLEC TLVEITHRPS EALDADFIIV LEDGQLTMMD TPSNVSQHNA FFRTAVMEEE
Q > RXA02095 (1-1404, translated) 468 residues
MKTEQSQKAQ LAPKKAPEKP QRIRQLISVA WQRPWLTSFT VISALAATLF ELTLPLLTGG
AIDIALGNTG DTLTTDLLDR FTPSGLSVLT SVIALIVLLA LLRYASQFGR RYTAGKLSMG
VQHDVRLKTM RSLQNLDGPG QDSIRTGQVV SRSISDINMV QSLVAMLPML IGNVVKLVLT
```

Appendix B, page 16

```
LVIMLAISPP LTIIAAVLVP LLLWAVAYSR KALFASTWSA QQKAADLTTH VEETVTGIRV
VKAFAQEDRE TDKLDLTARE QLFAQRMRTAR LTAKFIPMVE QLPQLALVVN IVGGGYLAMT
GHITVGTFVA FSSYLTSLSA VARSLSGMLM RVQLALSSVE RIFEVIDLQP ERTDPAHPLS
LPDTPLGLSF NNVDFRGILN GFELGVQAGE TVVLVGPPGS GKTMAVQLAG NFYQPDSGHI
AFDSNGHRTR FDDLTHSDIR RNLIAVFDEP FLYSSSIPRE HLDGFGCQ

> RXA02099 (1-273, translated) 91 residues
MGADQIAAVS GNSAWMLMSA SLVLLMTPAL ALFYGGMSRQ KSVLNMMMMS FGALGVVTVI
YLLWGWSMSY GTQSIAGIFA NPFEFFGLKD S > RXA02115 (1-1197, translated) 399 residues
TRATKSVGTV LALLWFAIVL DGFDLVVLGA TIPSMLEDPA WDLTAGQATQ ISTIGLVGMT
IGALTIGFLT DRLGRRRVML FSVAVFSVFT LLLAFTTNVQ LFSLWRFLAG VGLGGALPTA
IAMVTEFRPG TKAGSASTTL MTGYEVGAVA TAFLGLFLID GFGWHSMFIA GAVPGLILLP
LLYFFLPESP QYLKISGKLD EAQAVAASYG LSLDDDLDRE HEEELGESSS LSSLFKPSFR
RNTLAIWGTS FMGLLLVYGL NTWLPQIMRQ ADYDMGNSLG FLMVLNIGAV IGLYIAGRIA
DKNSPRKTAL VWFVFSAFSL ALLAVRMPLI GLYGIVLLTG IFVFSSQVLI YAFVGENHPA
KMRATAMGFS AGIGRLGAIS GPLLGGLLVS ANLAYPWGF > RXA02128 (1-1695, translated) 565 residues
MRGYQRSWLK GDVIAGITVA AYLVPQVMAY AVIAGLPAVV GLWGVLAPMA LYFFLGTSRN
LSVGPESTTA LMTAAGVGAL VGAAGGPERY AEVAALLAIA VGIVCAVGFI GRLGFLTRLL
SRPVLVGYLI GIAVLMIVSQ LSKVTQVNVE SGQTWQEIIS FIKVAGQAHI PTVILAVVVL
SLLYLANWLT PKFPSTLMVL LLSAAAVGFF HLDRFGLEVI GEVPRGLPQP SIPSIGDLEI
WSLLPYAVGI AIVGFSDNVL TARAFASGKD EVIDSNQELL ALGTANLANG FFQGFPVSSS
GSRTVLGDTA GARTQVHSLV VVALVIMVLL FAGPVLESFP DAALGALVIY AATQLIDIAE
IKRIARFRKS ELVITAATAA SVVASGVLAG IGVAVTLSIL DLIRRITRPY ADVLGYTPGM
AGMHSLEDYP ESTAVEGLVV FRYDSPLFFA NADDFSKRAI EAVDEATQPV HWFLLNAEAN
TEVDLTAVDA MEALRKTLEE RGIRFAMARV KQDLRRSLEP AGFIESVGEE YIFATLPTAV
KGYSVEFRDR FGNYPEGVPK EILEL > RXA02133 (1-306, translated) 102 residues
ENPYIGGAGY NAAKFGVAAF NRVLRLETHQ QTLRVSEIDP GRVATEEFSL VRFGGDKERA
EAVYDDVLNL TAEDIAESVR WVASLPKHMN IDRMRITPRD QV > RXA02150 (1-801, translated) 267 residues
VGNVFLEVPT AVKREEGVNP NIMKNNWYRL FKYVLIGPFL RVYNRPEIEG KENIPAEGAA
IMASNHEAVM DSFYFPLLCP RQLTFPAKAE YFTSPGIKGK MQKWFFTSVG QVPLDRTADN
AMDSLMNTAK MVLDRGDLFG IYPEGSRSPD GRIYKGKTGM AYVAMETGTT VIPVAMIGSR
DANPIGSWFP KPAKVRIKVG SPIDPLAFVK EHGLKPGTYE AARKLTDHVM FILADLTGQP
YVDAYSKDVK NALEEGKYYP EGTAPSQ > RXA02171 (1-1653, translated) 551 residues
MNSTILLAQD AVSEGVGNPI LNISVFVVFI IVTMTVVLRV GKSTSESTDF YTGGASFSGT
QNGLAIAGDY LSAASFLGIV GAISLNGYDG FLYSIGFFVA WLVALLLVAE PLRNVGRFTM
ADVLSFRLRQ KPVRVAAACG TLAVTLFYLI AQMAGAGSLV SVLLDIHEFK WQAVVVGIVG
IVMIAYVLLG GMKGTTYVQM IKAVLLVGGV AIMTVLTFVK VSGGLTTLLN DAVEKHAASD
YAATKGYDPT QILEPGLQYG ATLTTQLDFI SLALALCLGT AGLPHVLMRF YTVPTAKEAR
KSVTWAIVLI GAFYLMTLVL GYGAAALVGP DRVIAAPGAA NAAAPLLAFE LGGSIFMALI
SAVAFATVLA VVAGLAITAS AAVGHDIYNA VIRNGQSTEA EQVRVSRITV VVIGLISIVL
GILAMTQNVA FLVALAFAVA ASANLPTILY SLYWKKFNTT GAVAAIYTGL ISALLLIFLS
PAVSGNDSAM VPGADWAIFP LKNPGLVSIP LAFIAGWIGT LVGKPDNMDD LAAEMEVRSL
TGVGVEKAVD H > RXA02173 (1-1452, translated) 484 residues
MVWGMEHTSA LTLIDSVLDP DSFISWNETP QYDNLNQGYA ETLERARSKA KCDESVITGE
GTVEGIPVAV ILSDFSFLGG SLGTVASVRI MKAIHRATEL KLPLLVSPAS GGARMQEDNR
AFVMMVSITA AVQRHREAHL PFLVYLRNPT MGGAMASWGS SGHLTFAEPG AQIGFLGPRV
VELTTGHALP DGVQQAENLV KTGVIDGIVS PLQLRAAVAK TLKVIQPVEA TDRFSPTTPG
VALPVMEAIA RSRDPQRPGI GEIMETLGAD VVKLSGARAG ALSPAVRVAL ARIGGRPVVL
IGQDRRFTLG PQELRFARRG ISLARELNLP IVSIIDTSGA ELSQAAEELG IASSIARTLS
```

Appendix B, page 17

```
KLIDAPLPTV SVIIGQGVGG GALAMLPADL VYAAENAWLS ALPPEGASAI LFRDTNHAAE
IIERQGVQAH ALLSQGLIDG IVAETEHFVE EILGTISNAL SELDNNPERA GRDSRFTRFE
RLAQ

> RXA02224 (1-1797, translated) 599 residues
MAQHERVADA LQPASLAESW RELKTMPSGP KAWWYVSFVV ISVVTVVAMV GTSNLLGYSV
DLINGQSLPL IGSGSTAMIW LLGLVGAGIL AETAGRALLQ LVINTLARRL SVDLRKAALS
SALRAPVPDV MELGTGNVIS RLTQDIDNTV RIVGMVGVRL VITILILPSS LFALMTIHWT
FVILFIAVIV VLIPSGRKAV RAIPSATNIV SSTEARRNNL LLDTIRGIET LRVLKLGAWG
VQRMRQASWT AVQATADRAP IFTRLLALGS IAYGLLLIGV FGLSAFWVAQ DAMSIGAATA
AVFVVVRMEI HVFNVLFFAS EIQSASTSLG RAVSLAQMAR RTEQLSESAD CTEPPSVTVQ
DVTFKYPGGV AILEDFNLVL EAGTTTALVG TSGAGKSTLA GVIAGLQRPD SGAVLVGGIN
TATVTDTWTT RQVALISQEV HLFAGTLAED LRMANAHATD AQLHAALESV GLGQMTTAFR
RFFPSGLDTK IGAGAEELTP EIQQQISLAR IVLRNPPVLI MDEATSEAGS DDARMLEKAA
TEIARNRTTL VVAHRLDQAV VADRIIVMEQ GTITEDGTHQ ELLAFEGRYA QLYQRWSAQ > RXA02225 (1-882, translated) 294 residues
QTEERFGAAA DEALAIMLKE ARLQSLLTFV RQLVPAVFSV GLLAYASLLA FDGDITGGEM
ISVTLLVPPS LTVLGVSLGM MTEIWARGQA STKRVQNLVT ELDKAAAEPR PQPATFEFEE
GITVWDPSTP EARDVIDREL EALQVREDVI VAPHRVSVFE GVLKDNLNPM GTIAPEMLRA
ALHAASCEDI LSRLGADLNM PGEFELPDTL IGEAGLNLSG GQRQRIALAR FLAVDPEVLI
LDEPTTGLDA VTLDEVAHRV EKLRRGRKTV VITSNPTWHG VAKQMQSDFS EGVK > RXA02233 (1-1212, translated) 404 residues
VLVTSTWGWT VHGDGKKIEP GAVVAPKERL SWGRTIGIGM QHVIAMFGAT LLVPTLTGFP
VNTTLLFSGL GTILFLLITR NRLPSYLGSS FAFIAPLTAT QVHGIGVQIG GILVAGLVLV
AIGFVVKAAG KRVIDAVMPP AVTGAIVALI GLNLAPTAAG NFSSQPLVAT ATLFAILIAT
VAGRGMIARL GILIGVVIGW VFAAITGNLS EGAADTIREA AWFGLPQFHK PEFQLSAILV
TLPVIIVLIA ENVGHVKAVS EMTLGEDLDDL AGDALIADGF GTTLAGAFGG SGTTTYAENI
GVMAATRVYS TAAYWVAACT AIALAFIPKF GALIFTIPAG VLGGACLVLY GLIGMLGIRI
WQDNKVNFNN PVNLTMAAVA LVAGIGNLTL TVFGVTLEGI AWAL > RXA02253 (1-927, translated) 309 residues
MIQSTGVTHT DKSAQENPVK YRDNFTPVII TGMSGAGLST AARVLEDLGW YVAHNIPPQI
ILELIDMCAR EDSPVDKVAV VCDVRSREFR GSLTQVVSEL RDKQLDPTVL FLEARDEVLI
KRFDNVRRTH PLQGSQTLQV GIERERTVLS PVKEDASVVI DTSDLSVHDL RRAIESSFRT
IATRTQHVTI ESFGFKHGSP RDADFVVDVR FLPNPFWVPE LRPFRGVDKP VSDYVLSQKG
AEEFLNNFVD MLKDMLPGYR HEGKNFITIG VGCTGGHHRS VAVSEELAKR IADQTTLDVS
VVHRDINRH > RXA02261 (1-1356, translated) 452 residues
MDPSDLAWIL AAFALVSLMF PGLSLLYGGM LGGQHVLNTF MMVMSSLGII SLVYIIYGHG
LVLGNSIGGW GIIGNPLEYF GFRNIMEDDG TGDLMWAGFY ILFAAISLAL VSSGAAGRMR
FGAWLVFGVL WFTFVYAPLA HWVFAIDDPE SGYVGGWMKN VLEFHDFAGG TAVHMNAGAS
GLALAIVLGR RHSMAVRPHN LPLILIGAGL IVAGWFGFNG GTAGGANFLA SYVVVTSLIA
AAGGMMGFML VERVFSGKPT FFGSATGTIA GLVAITPAAD AVSPLGAFAV GALGAVVSFW
AISWKKGHRV DDSFDVFAVH GMAGIAGALF VMLFGDPLAP AGVSGVFFGG ELSLLWREPL
AIIVTLTYAF GVTWLIATIL NKFMTLRITS EAEYEGIDRA EHAESAYHLN SNGIGMATRT
NFGPEIPEET VPDAVQVGVD KQKIADTRKA SK > RXA02268 (1-900, translated) 300 residues
MSQENSGLFK RAITRGVAKV RRNPREDFAE EFTQELYDHA TNITLPLTAR LKPNGFFQDD
WRARPSGARP WPIVLIHGSG ASKGSWEEMG AELRSKGWAV FAPDFGTRAT EPIAASAAQI
GAYIDAVLLV TGAAQIVLVG HSQGGVVARY WMRTYGGYMK VRHMISISTP NHGTLMGGIL
NPMTKVKSGE GTIEKLMHRL FGPTGFEQLR GHDIIEFLAD GGDLDPGVTY TCIGTHFDPF
IQPPEVAFLE VNEDDDPNRV HNIWVEDEHP RAMIAHNDMV RDPRVIEIVR AELDRVARLG > RXA02269 (1-972, translated) 324 residues
MVDALNDLRR ELTNALRSVW KNLPTDNAPQ ADALPDDVVE EIAINFYRDP KNRGKLNEDK
TDSLPMLARI RSRGLFEDDW RARPTEDRPW PVVLVHGTGS TKGDWQDLGA DLRRDGWAVF
APEFGQRATG SVAESSAQIG AYIDTVLLAT GASKVIVVGH SQGGVLLRYW MRVLGGASKV
```

Appendix B, page 18

Attorney Docket No.: BGI-125CP

```
KHMVSLAVPN HGTTMGGIVS PLIRNNRGES VVNSVVQSWF GEAGFEMIRG HDTINAINEG
GDLDPDVTYL CIATHFDTVI QPPETCFLEA RNPEELKRVQ NIWVENLDPN SVVLHEAMPY
DPRVRALVRA DLSKLVEISE TAEN

> RXA02309 (1-975, translated) 325 residues
MSSGRTVPTR SHGLGKEGVS TTGASQVEFG DPELTARIND AMVQVEELLH TELSSGEDFL
VDIVMHLTRA GGKRFRPMFA LLASEFGEKP LSENVIKAAV VVEITHLATL YHDDVMDEAS
MRRGVPSANA RWDNSVAILA GDILLAHASG LMSQLGTDTV AHFAETFGEL VTGQMRETVG
PRDTDPIEHY TNVIREKTGV LIASAGYLGA MHAGAAPEHI DALKNFGAAV GMIFQIVDDI
IDIFSETHES GKTPGTDLRE GVFTLPVLYA LREDTPVGAE LRDILTGPLE DDETVNHVLE
LLSQSGGRQA ALDEVYRYMD IANAE > RXA02310 (1-1263, translated) 421 residues
VSTTFDVLII GAGPSGASAA VHAARTGLQT LLIDASSFPR DKTCGDGLTP RAIHQLELLG
VADQVTGDYF NKGLKLHGFG GSVEAPWPET YFTNKGSAMS RMEFDDLLFR LAKSHEEVTT
WENASAQDPI LRGNFLEGVV INHAGQEKTV KAKHVIIADG VRSPFGKKLG RQWQRDEVYG
IAARAYCETP LSDEPWIHSH VELRDEDGVV QPGYGWIFPL GNGTVNLGCG ALSTDTRPAK
INTKKLLSFY AGQRRKAWQL GPEHDVASAL LPMGGAVSNV AGANWMLIGD SAACVNPLNG
EGIDYGLETA AMAVDTLVEN PKRDLTLVWP HRLRDAYGET FMLARTAARL LTYPQFLPMA
GPLAFRGPLQ KAIMPAAARL MGNLITEEDK DLLARGWQAA GSAISWARKG SPLWDSTSSL
V > RXA02320 (1-588, translated) 196 residues
MTAAQTKPDL TTTAGKLSDL RSRLAEAQAP MGEATVEKVH AAGRKTARER IEYLLDEGSF
VEIDALARHR SKNFGLDAKR PVTDGVVTGY GTIDGRKVCV FSQDGAVFGG ALGEVYGEKI
VKVMDLAIKT GVPLIGINEG AGARIQEGVV SLGLYSQIFY RNTQASGVIP QISLIMGACA
GGHVYSPALT DFIVMV > RXA02321 (1-444, translated) 148 residues
EYGGILRRGA KLLYASXEAP VPKITVTMRK AYGGAYCVMG SKGLGSDINL AWPTAQIAVM
GAAGAVGFIY RKELMAADAK GLDTVALAKS FEREYEDHML NPYHAAERGL IDAVILPSET
RGQISRNLRL LKHKNVTRPA RKHGNMPL > RXA02335 (1-1773, translated) 591 residues
VSVETRKITK VLVANRGEIA IRVFRAARDE GMGSVAVYAE PDADAPFVSY ADEAFALGGQ
TSAESYLVID KIIDAARKSG ADAIHPGYGF LAENADFAEA VINEGLIWIG PSPESIRSLG
DKVTARHIAD TAKAPMAPGT KEPVKDAAEV VAFAEEFGLP IAIKAAFGGG GRGMKVAYKM
EEVADLFESA TREATAAFGR GECFVERYLD KARHVEAQVI ADKHGNVVVA GTRDCSLQRR
FQKLVEEAPA PFLTDDQRER LHSSAKAICK EAGYYGAGTV EYLVGSDGLI SFLEVNTRLQ
VEHPVTEETT GIDLVREMFR IAEGHELSIK EDPAPRGHAF EFRINGEDAG SNFMPAPGKI
TSYREPQGPG VRMDSGVVEG SEISGQFDSM LAKLIVWGDT REQALQRSRR ALAEYVVEGM
PTVIPFHQHI VENPAFVGND EGFEIYTKWI EEVWDNPIAP YVDASELDED EDKTPAQKVV
VEINGRRVEV ALPGDLALGG TAGPKKKAKK RRAGGAKAGV SGDAVAAPMQ GTVIKVNVEE
GAEVNEGDTV VVLEAMKMEN PVKAHKSGTV TGLTVAAGEG VNKGVVLLEI K > RXA02343 (1-414, translated) 138 residues
MTISSPLIDV ANLPDINTTA GKIADLKARR AEAHFPMGEK AVEKVHAAGR LTARERLDYL
LDEGSFIETD QLARHRTTAF CLGAKRPATD GIVTGWGTID GREVCIFSQD GTVFGGALGE
VYGEKMIKIM ELAIDTGR > RXA02364 (1-627, translated) 209 residues
MEPLFQSLAE SDNISVIGGF TQGTRNLYTT DAPVKRPADL AGKKIRVQES AMHIRMIELM
GGSATPLTYG EVYTAMQSGV LDGAENNEIS YVTQNHFEVA RYNSNTNHLV GLDYMVMRHD
LLDAMSEPDR ELFLEEWDAA MTEHTDLWNT ETDAVIEKAK AGGAEFVEVD AQAFTDALAP
IKDEFLTSEF QRELYEAVRA ADTSGGAAS > RXA02372 (1-555, translated) 185 residues
DAVNKMDRTD FVETFAPLFN SKTWPLETAW ESQPFANVTE LREAIQVAVL TAPLSDREEL
IHDYPDMAQL ILATEEEAAT ISQDRGSIGL DDLDDVDQEK LITVTEQYRE RFNMPYVAYF
DTMDSVDTVV AAGLRRLDNS DEQEHRQALS EIIEIANDRF DILLADANPA RSAFDRKFTE
TDFLG
```

Appendix B, page 19

Attorney Docket No.: BGI-125CP

> RXA02377 (1-1191, translated) 397 residues
VPPAPKLAAL GLQHVLAFYA GAVIVPLLIA QSLNLDTATT IHLINADLLT CGIATLIQSV
GIGRHIGVRL PIVQGVTTTA VAPILAIGLG VTDGQGGVAS LPAIYGAVIV SGIFTFFAAP
VFARFLKFFP PVVTGTVLLV MGASLLSVSA NDFVNYADGV PAARDLAYGF GTLAVIILAQ
RFFRGFMGTL AVLIGLVGGT AVALILGDAN LDEVGNAEAF DITTPFYFGV PEFNAVAIFS
MIIVMIITMV ETTGDVFATG EIVGKRTRRS DVTRALRADG LSTLMGGVMN SFPYTCFAQN
VGLVRITGVK SRWVAAAAAG FMIILGVLPK AGAIVASIPS PVLGGASLAL FANVAWVGIQ
TIAKSDLADS RNSVIVTSAL GLAMLVSFRP DVAQGVP > RXA02397 (1-996, translated) 332 residues
MNDFETTIDR ISKEQDPAAR SRVEQFIVET VRALPNLTTK QGASLAIQLL DAVQLADAAG
TKGGASTSNA SSLPDTFDAL TSLIGKLDVR SDSEWRSFGF QPSETAHPLM IAIPEIEIFY
QHTDVEPGSD DAVAPDFQEN QDMWRRRLGS VTEPNLIYKE FSGPGKAQRA VEMLGNLWKI
GVVVSRNTES RLGLTRVEYT PTPGEVPVPL MSEKNCWYSI RVSETIGENQ VPEIVRCLGE
IFCGYLPQMW LKEPVKAGKL RIQESEAAAY IAMARLDLSP RTGNTTWTNS YISTRPLSPA
FRWDVVLEAS HQLENLLRGD TGPVTATQSA AG > RXA02424 (1-381, translated) 127 residues
TGATHYAPFL EVPALPSAVD VELHHGDSIE FEGHVFPISI LRGHTPGGAV LTAEIDGKTH
LFVGDSLFPG GLGKTSSEGD FVRLFNDVKE RIFDTYDDDS IVWPGHGKET TLGAERPQLE
IWWERRW > RXA02426 (1-1533, translated) 511 residues
MLITLLLATV IVVAIGDKTG LPWPALMTIV AAGGALLPFL PEFTIPADLM LPIFIPPLLW
ALARKSSWAV IRSQMSTIIT MSVLLVFVTI AALTGASMLL LPGIGLAGAI MLAAAIAPPD
PVAVDAVAEP AGIPKRITTT LQTEGLFNDA ASIVAFHVAL AALVAGEDLS WSTGVLEFLW
SCLAAVILGL VIGRAAAWFT DHVSSVEARN AFTWVLPFAI YVVAEEIGGS GVIAIVIAAV
EMNSRASIGA EDRLTGSAFW GTIEVLFTGV AFGLIGLNVR AAIDEVGSEL WHAVVVGIVL
SVVAIVVRGV WMFAAYKRNR FKIDKKGATN SSLRAPLRLQ ESLLMTWAGM RGLVTLALVL
SIPEDIFPYH HELQVIALVV LLITMVGPGL TLPWLMRKLS LDKGPDAAGD ESIAALTERA
HKAATTYLVD TTELPMEQMV AIKNWFSQEI DADELQENVD KLHQRAHHAR VGAIKAAQEE
LLKARRERGV NPAYVDEVLT NIDRMLVAAE R > RXA02487 (1-288, translated) 96 residues
VYPAEVEEVL AEHPDIEDSA VVGIPREDGS ENVVAAITLV EGAALDPDGL KEFARKNLTR
YKVPRTFYHF EEMPRDQMGK IRRREVQAEL LKKLGK > RXA02490 (1-813, translated) 271 residues
MSAYETKEWL QHYPEWTPHS LEYGDTTLLD VYDNNLAINA DKPATYFFGR SQTYGELDKE
VRKTAAGLRA LGVRPGDHVA IILPNCPQHI AAFYAVLKLG AVVIEHNPLY TAHELLEPFK
DHGARVAIVW DKASPTVEQL RGQTQLETIV SVNMINAMPP LQRLALRLPI PALRKSRESL
SGAAPNTVPF ETLTSAAMGG DGDDVVSEPT VTKESVALIL YTSGTTGRPK GAQLTHGNLF
SNLLQGKHWV PGLGDKPERM LAALPMFHAY G > RXA02511 (1-657, translated) 219 residues
MLGLHGRKPA QVIVEPVAKL MIKLKVTPNQ LTLVSAGLTV GVALLLIPTG HLIWAAVLTG
LFAAFDMIDG TVARMQGGGT KFGATLDATC DRITDGALFG AITWWLVYSY DAPQALVAAS
LVCLVASQVI SYVKARGEAS GFTMDGGLVE RPERLIVSLV GLGLTGMGVP YAIDVALWAL
AAGSIYTVVQ RLVMAGKSPL AKEFTKAPAG AKADYSNTK > RXA02512 (1-957, translated) 319 residues
MKPKDFCTAE NWAENLSALG YLAGWRFVRM LPLPIARRVF DLGADLASKS GKGMGQLRAN
LARVVGAENV TQALVKQATR SYARYWLEAF RLPAIARDPE LLARLRKGTV GLDLLDESLA
AGKGVVLTLP HSGNWDMAGA FLISHHGQFT TVAERVKPER LFEAFVEFRE SLGFEVLPLT
GGERPPFEKL KERLTSGGIV CLLGERDLRH SGVETTFFGE KTSMPAGPAQ LAIETGAALH
VVHPWFDDDG WGLSVSDAVT VDNLSDTVQR IAHLFMANIT AHPADWHMLQ PLWFGDLDPE
RLKRSREQTN VHKPVALQE > RXA02527 (1-1329, translated) 443 residues
MFGLFIATIV AIILKPMPMG AVTIIGMIAA VLTGLVPLTA SSDDPGAVYG LIGFSNGTIW

```
LIVMAFLISR GFIKTGLGRR IALFFVSKVG GKMLGVTYGL ALADLVLAPA IPSATARGGG
IMAPIMKSVA LTYDSTPGPT RRRAGAFLAL NVGQVNAITC AMFLTAMAGN PLIASLASQM
DVNITWTNWA VGAIVPGLVA LIVVPWVVYK IYPPELKDTP EVKKMASDEL KQLGGFTYGE
KVLAGTFVVL LLLWTGGDLV LGISATTTAF VGVIILLVAH VLTWEDIIQE KTAWDTMVWF
AVLYMMATAL SQYGFIAWIS EVIASSLGGM NWVVALVVLV LIYFFSHYFF ASATAHISAM
YLAFLGAAIA IGAPPLMAAL VLAYTSNLFS SLTQYSGGPS PTLFGLNYIT VGEWWRTSAI
AGAVSITIWL VIGGLWMNVI GLW

> RXA02547 (1-2124, translated) 708 residues
AARLTVDEYP AAREALESAG QRNVEDRTRA VDEFKAADQE LSSLSKGSSN IEYRLLQVRE
NLCQDLGVSP RDMPFAGELI DPNNAEWEPV VQRILGGFAA EMLVPHGLLP RVRDWVNAKH
LAALLKFNGV VTTGEYKTSR FPADSLIRKV DVVESPFRDW VNQELGKRFN IRCVRTPEEL
SALGPRDQGV TILGVRKFAQ QTGDPTTRWE KDDRRKLGDR STYRLGSTND AKVETLRETV
KAGKAVVQAA DNRIAANRAE LRELERQYQA SQEILKVSWA QIDVESADAA IAELDRLLEE
LNNTPEATEL SARHEAAKQT LARVSDLLVA AQSEETVASM NLKRAETELK RLESLPVAEV
SEEIAREVEK LFLANTRRVH AANVDEQTIA LREDLDKQID ANEAELRRCE NQIVGILRSY
IETWPANRAD LQAEPEFVGE AINRLGELRS DRLAEFTAKF LGLMNEMSTR NLGQISRRLR
DARREIEERI EPINASLAQS EFNEGRFLHI DIRDQSGPIV REFQQKLDAA TSGDLGTSTE
KQAFARYALI AEIISKLASH DSADARWRNT VLDTRRHVRF IGLERDSDGA TVNTYVDSAS
LSGGQAQKLV FFCLAAALRY QLAEPGAHYP TYATVILDEA FDRADPAFTR QTMNVFHSFG
FHMVLATPLK LIQTLGDYVG STIVVSYTEK PNAQGAIQGN SSFSRIEK > RXA02561 (1-660, translated) 220 residues
MVGASNGVTL SMGSLLAAHL AGASWGGSAA TLTTIGAAIF SIPLARMVST YDRRTSLSTG
MLLGCVGALL AILGAQFGLF PVVLLAFLFL GSMSAVNLQA RFAATDVASE ETRGRDLSIV
VWSTTIGAIA GPNLFEPSAR FSETLGLEQH AGAYLLCLFG QLIAIAVWRF TLPKGLKPEA
TPNAPTEKKR LTPKALQAIT SVATAHFSMV GLMSMAAIHM > RXA02566 (1-438, translated) 146 residues
ISLHVAGMYA LSPVFGLLTD KLGRNVTIYS GFAMLATSAA FLIIWPEPQW AMITSMILLG
LGWNSALVGS STLLVDATPI HHRTYAQGRS DLTMNLAGAS GGLIAGPLIA MGGMPLLAGV
VLAVVALQTV LSFRTRSIEK TPASCF > RXA02571 (1-1029, translated) 343 residues
VVALTQIVGP SGSGLTRELE KRYRETPGAV MLTADPRAHI TYLRATVAEE LAFGLEQRGI
VPAQMWERVR NIGLGLENLL DRAPAQLSGG QTRRLAIGTV AILEAPTMLL DDPLSGLDTS
SRAQLITMLE SYEGDVIAAA HKRWLDAPTV YLGDLEELSL PARVEFSGPS RTFSAITGTR
GQQRRRWWQF NESQPQFQIG PLDITVSAGQ VLWLQGPNGS GKSTLLRGLA NEPGTELMLQ
NPSDQVIDST VANWVPGSNS EEHPLDLSQR ELRLAQCDAA LGNNPEVLLA DEPDVGLDVG
GRNAIHQRFA DFLGNGGALI LTCHDETFVA EVAEYAIVKE MGL > RXA02578 (1-1104, translated) 368 residues
MSTQSYAPIR HRGFISSLEG LRAIASLGVL ATHVAFQTSV DPASNIGAVL ARFDFFVAVF
FALSAFVLWR RRAGQPVGLY YLKRLARIMP AYWATVIAVL LFIPTGPWLA NLTMTQIYWP
DGLMTGLTHL WSLCVEVAFY LVMPLLAWVL DRFGRPVRIL LIVGGAVLSL AWPWIPLVEH
ALDEGWANMQ IWPPAYACWF AVGMIAAEIE GVRFPRVPSF VWVGLALVVA WIAGQEWFGP
LGLVHPSPWE FNLRVLAGTL FAVFLVVPYA LGTPSRLLDS SWMKTLGTWS YSIFLWHLPV
LTIVFPLLGL PLFSGNFLLV FIVTVLLTIP VAAISYTFIE EPISGGPGAP FRLGVVRIHH
FSGGRSGK > RXA02581 (1-1527, translated) 509 residues
VPVPLYDPNE PGHADHLNAV FADSEPVVVL TNSKSAGAVR KHFSSLPAAE RPRILSVDSL
PDSLADSYEN PMLTEAGRRL AALRQSAPID LTAFLQYTSG STRTPAGVVL TNRSILTNVL
QIFSAAQLKT PLRLVSWLPL HHDMGIILAA FVTMLGLDNE FMNPRDFVQQ PSRWIKQLNR
RESDVDVNVY TVVPNFALEL AARYAKPAEG ETLDLSALDA IIIGSEPVTE NALTTFREAF
EPYGLPVQTL RPSYGLAEAS LLVTTPQTEN RPLISYFDRE ALAENRVELV EKGNNKAVAF
VSNGQVAAPQ QLVIVDSETG TELADGQIGE IWTHGENTAA GYLDREEDTA ETFRNRLTTR
LEENSRAEGA ADDNYWMATG DLGVIVDNEL YITGRLKDLI VVAGRNHYPQ DIEYTVQAAS
AHIRADSVAA FAVPGDDIEK LIILAERDTT ANEADDAAAE EAIRSAVGTA HGVVPEEIRI
LAPDEIARSS SGKIARRVNQ RNYIQEQAN
```

Appendix B, page 21

Attorney Docket No.: BGI-125CP

```
> RXA02582 (1-4830, translated) 1610 residues
MEQSQSSDQK MTVEQVRTWL RDWVVRTTGI PVEEVTDDKA METFGLSSRD VVVLSGELEN
LLDTSLDATI AYEYPTIRSL AQRLVEGEPR RAHTQRELNF SAVSDSPGSH DIAVVGMAAR
YPGAESLEDM WKLLVEGRDG ISDLPIGRWS EYAGDEVMSR KMEEFSTIGG YLSDISSFDA
EFFGLSPLEA ANMDPQQRIL LELTWEALEY ARIAPNTLRG EAVGVFIGSS NNDYGMMIAA
DPAEAHPYAL TGTSSAIVAN RINYAFDFRG PSVNVDTACS SSLVAVHQAV RALRNGEADH
AIAGGVNILA SPFVTTAFAE LGVISPTGKI HAFSDDADGF VRSDGAGVVV LKRVDDAIRD
GDKIIGVIKG SAVNSDGHSN GLTAPNPDAQ VDVLQRAYVD AQVDPTTVDY VEAHGTGTIL
GDPIEATALG AVLGYGRDAS TPTLLGSAKS NFGHTESAAG IAGVIKVLLA LQNKTLPPTV
NFAGPNRYID FDAERLEVVE DPREWPEYNG HAVAGVSAFG FGGTNAHVVI SEYNAEDYET
RAPKEALLPD QQVALPVSGH LPSRRRQAAA DLADFLEGRK DCDLTPVARA LAGRNHGRSR
AVVLASTIEE AVKRLRQVAE GKVSVGISAA DSPAANGPVF VYSGFGSQHR LMIKELCSIS
PQFRERIEEL DEMVKFESGW SIMKLVLDDE QTYDTETAQV VITAIQIALT DLLASFGVKP
AAVMGMSMGE IAAAYAAGGL SDRDTMLIAS HRSRLMGEGE KSLAEDQLGA MAVVEFAAAD
LDKFIEENPE YKGIEPAVYA GPGMTTVGGP RDAVVQFVEK LESEDKFARL LNVKGAGHTS
AVEPLLGELA GEIAGIEPLP LQIPLFSSVD QGVTYPVGAV VHDADYMLRC TRQSVYFQDS
TEAAFAAGHN TLVEISPNPV ALMGMMNTAF TVGKPDAQLL FSLKRKVPEA ESLRDLLAKL
YVNGANVDFS ALYGEGETID PPHITWKHQR FWTSARPSSG ASLDLPGFRV NLPNNTVAFS
TAAELAPSAV AIMEAAAMAV TPGSSVDAVD ERDMLPPSGE ITTIVTRSLG GLSLSVYKIE
GTTSTLVAEG FAANPGFAAA SSFDGPGYDG FNTDYSDQPD PRSDLPLDIE AVRWDPATET
VEERMRAIVS EAMGYDVDDL PRELPLIDLG LDSLMGMRIK NRIENDFQIP PLQVQALRDA
SVADVVIMVE NMVAGRSSET LVDATPQVPA EAAGEAQAAE SSASGEDVQG VGVAPRDASE
RMVFGTWAGL TGAAAAGVTS KLPQIDVDTA TAIAERLTER SGIEISTEQV LAAETLEPLS
DLVREGLETE VQGNIRVLRG RAEGSTKPAV FMFHPAGGSS VVYQPLMRRL PEDVPVYGVE
RLEGDLADRA AAYVDDIKKY SDGFPVVLGG WSFGGAVAFE VAHQLVGSDV EVATVALLDT
VQPSNPAPDT AEETRARWTR YADFAKKTYG LDFEVPFEIL DTIGEDGMLS MMTDFLANTD
ASEHGLSAGV LEHQRASFVD NRILAKLNFA DWANVEAPVI LFRAERMHDG AIELEPNYAK
IDQDGGWSGI VNDLEIVQLN GDHLAVVDEP EIGTVGAHLS RRIDEISRKN > RXA02583 (1-1548, translated) 516 residues
LSNTTTAEKL ADLRARLEIA KDPGSERARK KRDEEGRTTP RQRIDALLDA GSFVEIGALG
RTPDEPDAPY SDGVVTGYGR IDGRPVAIYA HDKTVYGGSV GMTFGRKVSE VMDMAIRIGC
PVIGIQDSGG ARIQDAVTSL AMYSEIARRQ LPLSGRSPQI SIMLGKSAGG AVYAPVTTDF
VIGVQDGETEM YVTGPAVIKE VTGEQITSAD LGGLGAQQMQN GNISYLASSE EEALNMVKDL
LDFLPLTCND PAPVFAAPTD EEIAYDEALN SFMPDDTNQG YDMHDLLDKL FDDANLLEIQ
EEYAPNLITT FARVDGKAVG VVANQPMDKA GCIDADAADK GARFIRICDA YNIPIIFVVD
TPGYLPGVDQ EKVGLIHRGA KLAFAVVEST VPKISLIVRK AYGGAYAVMG SKNLTGDLNF
AWPTAQIAVM GAAAAVVMIQ GKQLEAAPPE QREYMKKLFM DFYDENMTSP YVAAERGYID
AMIEPAETRL VLRRAVRQLE TKAVRDLDKK HTIMPM > RXA02599 (1-477, translated) 159 residues
MDQLILDAFI GLRVTWLSPV IILFTQLTGP TLMFVYALVW GLLRKSATAP IAVGLANLIS
HFLKRAFERP RPNTAEHLVV ETNFSFPSGH AVGAAACAVA VGYSVNRWWK LTLWVIALLV
GLSRLYVGVH WPSDVLAGWA IGALTSVVVF TSWNLLQRR > RXA02618 (1-438, translated) 146 residues
MTNTPFPLEL QNISCAFGEG PRHVSALNNV SLAVNPGELV AIMGPSGSGK STLLNVAGLL
QRATSGHVLI DGASASDLNA KRAAETRRRH IGVIFQNYNL VPTLTVGENI GLPLELDGKT
DRQAVAIALA EVGLKGSTTA FPERSL > RXA02634 (1-1611, translated) 537 residues
MRDLLPSRDD YQLLRFSWKM DIAAGVTVGI VALPLALAFG VSSGVGAEAG LVTAIIAGLV
AAIFGGSNVQ VSGPTGAMVV VLAPIVAQYG VGAVALLSLM AGVIVLVAGV LRLGRTVSFI
PWPVIEGFTA GIGVIIFLQQ VPAAFGYSGH LPTNALLAAI HTVSHATKDA ILPLLIIIVT
AAIMIVLGKI APKLPASFIA ILVVSIGVAL LKLPVELIGE LPNSLPAPHL PDVNLEMFTS
LLGPAFAVAA LAAIESLLSA RVAASMADTG PYNADRELVG QGLASISAGF FGGMPATGAI
ARTAVNVRSG GRTRIASIIH ALVLLGVVYV AANIVAVIPL AALSGVLMVT ASRMVSIEVI
SRVMRSTRSD AIVFVITAIV TISVDLVIAV GIGIAVATFF MLRRMSMNAG VFRETLPEPA
TLNDEKIGLF RIEGALFFGA AERLSQQILD YEDLEVVILR LSHIQMIDAT GAHQLTELVN
ALERKNVTVL IKGVRKEHIH VLGVLGAIRS LRHENHLFDD LAPAVEHARK HVKIDNS
```

Appendix B, page 22

Attorney Docket No.: BGI-125CP

```
> RXA02638 (1-504, translated) 168 residues
MARKRLNAGS LVGIFPEATV SRSFEIKELK TGAVRIADSA NVPLLPLIIW GGQRIITKDI
ERDFGRSHIP VFISVGEPVD ASGDPDEATE RLYEAMKKLL DETRTAYEQK YGPFEGGELW
RPKSLGGGAP TLEQAKMLEI AERERRQAKR AAKVAKKRTT FIRKIFKK > RXA02659 (1-312, translated) 104 residues
FGNDPDLLMR WWYAGDVWTD SRMHWKGSES YDQVQNLLEE GIRATDKAEQ QDIWNRTFDV
ISDNVPLYPL FHRKVPTAWN SNALVDFKPI SLTGLNFSGV ATTE > RXA02676 (1-1389, translated) 463 residues
MDTWEQTLGT GPLLGIAAGA IALILVLVIV FKLHAFLTLI LVSIVTALAA GIPVTAVVDT
LLDGFGKTLA SVALLVGLGA MLGRLVETSG GAKSLADTMV RIFGEKRAAF ALGVASLIMG
FPIFFDAGLV VMLPVIFAVA RRLNGSVLTF GIPAAGAFSV MHVFVPPHPG PIAASEFFGA
QVGYVLIAGI IVALPTWYLT GYLLGKFLGR KFPLPVPDLL SGGAQEDDQP QNPANAVSII
VILLIPMLLI FGNTGTSMAV SAGLLDAEST MVKILGFLGE TPVALLITLI IALFFLGNRR
GINGSALEKT IEGALGPICS VVLITGAGGM FGGVLRTSGI GGALADSMAD LGLPVIAGCF
IVAAVLRVAQ GSATVALTTA AALMAPAVAA ADFNEFQLAA IVISTAAGSV IASHVNDSGF
WLVGRLMNAD VPTTLKTWTV NQTCIAIVGF VMAYAMFGLA SLA > RXA02677 (1-759, translated) 253 residues
MKVIAHRGLS SRFPELTESA FRAALELPIH GIETDVRLTK CGEVVNVHDP IVDRVSNGRG
RVSRLDLESL LSLNFGTKET PEKVLTLNNL LDIFEDYPDK HLYIETKHPM RYAVMLEEEI
TKILKYRGLT EDPRIHIISF ALPAMYRMAR LAPQLDRIHL RRSWERWGNP RDVRCGVPTG
LGLSLERAKM DPRMIGAKGL PTYLFTVDKQ KDMLWAREQG VDMLATNYPD RAAELLNAHP
KPAMYANAHG KED > RXA02691 (1-807, translated) 269 residues
MNTMPDQPLN QDGFPTASKG VEPDNLPDRV LVDGLKPKHQ QLREILEEIC TTQLQPGDML
PGERILEEKY GVSRITVRRA IGDLVASGRL KRARGKGTFV AHSPLISRLH LASFSAEMAA
QKLSATSRIL SSSRGPAPDD IADFFGTDRA AQHITLRRLR FGNGRPYAID NGWYNSEFAP
DLLENDVYNS VYSILDRVYG VPVTQAEQTV TAVAADEDTA RLLDVTPGAP LLRILRQSLS
GDKPVEWCVS LYRTDRYSLK TLVTRSEDL > RXA02718 (1-1047, translated) 349 residues
VRDRLTQFLD AQELTIADIG APVTDAVAHL RSFVLNGGKR IRPLYAWAGF LAAQGHKNSS
EKLESVLDAA ASLEFIQACA LIHDDIIDSS DTRRGAPTVH RAVEADHRAN NFEGDPEHFG
VSVSILAGDM ALVWAEDMLQ DSGLSAEALA RTRDAWRGMR TEVIGGQLLD IYLESHANES
VELADSVNRF KTAAYTIARP LHLGASIAGG SPQLIDALLH YGHDIGIAFQ LRDDLLGVFG
DPAITGKPAG DDIREGKRTV LLALALQRAD KQSPEAATAI RAGVGKVTSP EDIAVITEHI
RATGAEEEVE QRISQLTESG LAHLDDVDIP DEVRAQLRAL AIRSTERRM > RXA02749 (1-876, translated) 292 residues
MSPILKVRDL VKRYGDTVAV DGLNFDVSQG EIFAFLGENG AGKTTTISCL IGIDQATSGE
IELQGGQVDS EKLGVVFQQS VLDPLLSAKE NLETRGQLYP GVGKQRVAQL IEQIGMEGFA
DRRYGVLSGG EKRRTDIARA LLHSPDILFL DEPTAGLDPR SRRQVWDTIN SLRNDVGLTV
FLTTHYMEET ELADSVLIID RGKEVASGTP MELRARYTTT ELTLRRTNDPT HSGKELAHLS
PEIDGDRLRI KLENGLEAAR LATELDGVLD VEIRHGSMDD VFLAVTAERK RS > RXA02762 (1-285, translated) 95 residues
MLSELFPLAM RGFAIGISVF FLWIANAFLG LFFPTIMEAV GLTGTFFMFA GIGVVALIFI
YTQVPETRGR TLEEIDEDVT SGVIFNKDIR KGKVH > RXA02767 (1-783, translated) 261 residues
MRELALNMAG VTVRRGEKLL LDDISLSIPQ GSHWAVLGPN GAGKTTMLKI AATLLYPSEG
TVDILGHRFG RVDTRELRKT IGLVDPKQRF TNLPAHEIVL SGLTASNGLL PRWSASASEL
ERCALMLELV GMTARADRYW ADMSQGEKAR TLIARALIIS PTLLLLDEPT TGLDLPGRET
LLSVIDGLRA ALPGLTTVMI THHVEEIAAS TTDILMIKDA RILASGTVSE VMTPENLGAL
YDMSVSLETV RSRWFAFDAL H > RXA02792 (1-753, translated) 251 residues
MIEATHLRHS FGDNIVIDDV TLHLPAHGTV SLVGPNGSGK TTLLRALYGA LQPNEGHIHV
```

Attorney Docket No.: BGI-125CP

```
DGVPLISLHR KDIAKTMAVV IQEHDSDLPM TVADLVLLGR LPHQKMFAGN SQADQLLVKE
ALTRVGAIHL ADRQFGALSG GERQRVLIAR ALVQNATHIL LDEPTNHLDI RYQHEVLHLV
RELSSSSIIV LHDLNLAGAY SDHIILLDQG RVVTQGTPSE VLTPEHLEPV YGVRVERFDL
GDEVHLRFKR H

> RXA02794 (1-621, translated) 207 residues
MAASGLIFFV ARAAGRISST RLLMSGVAIG YMLSAATSFL IFSSDSAEGS RSVLFWLLGS
LGLAAWNGPM AIIFLIVGIA LALLMVLGPQ LDALNSGDET ALTLGVSPDR LRILLLVITC
LLVGSMVAMA GSIGFIGLVI PHLARRFVSG KHRLMLPVSA LMGAILLIWA DIAARTLLAP
QEIPIGIITA LIGAPFLLIL VRRMHTY > RXA02809 (1-273, translated) 91 residues
AALTNALSYL SAEWNNKAAG IVSYGSAMGV RAAEHLRGIL SELQIAHVQK TGLLSIFTDF
EYPNFKPSEQ GISSVDAMLE QLVVWTKAMS T > RXA02811 (1-384, translated) 128 residues
VTESTLGASN SSQTIENKGL TILGISGRRL AAVLIGWFFV IFDGYDLIVY GTVQSALAKE
WNLSSATLGT IGSTAFFGMA IGAVFIGRLS DRVGRKAAVI GSVLILSVFT MLCAFAPNPW
VFGAFRFI > RXA02836 (1-306, translated) 102 residues
MTIDEGRRQF EVNVFGAMAL TRLVLPHMQK QKWGTIVNIT SMGGKIYTPL GGWYHGTKFA
LEALSDALRL EVAPFGIDVV VIEPGGIATE WGGIAADNLD AV > RXA02850 (1-492, translated) 164 residues
EELGGATTHM VTAGNSHYTA ATDEEALDWV QDLVSFLPSN NRSYAPMEDF DEEEGGVEEN
ITADDLKLDE IIPDSATVPY DVRDVXECLT DDGEYLEIQA XRAENVVIAF GRIEGQSVGF
VANQPTQFAG CLDIDSSEKA ARFVRTCDAF NIPIVMLVDV PGFL > RXA02851 (1-519, translated) 173 residues
PRQKADIMIG SIQENINDVD LELDTIIPDS PNQPYDMKEV ISRIXDDAEF FEIQEDYAEN
ILCGFARVEX RXVGIVANQP TQFAGXLDIK ASEKAARFIR TCDAFNIPIL EFVDVPGFLP
GTNQEFDGII RRGAKLLYAY AEATVGKITV ITRKSYGGAY CVMGSKDMGA GLV > RXA02865 (1-1017, translated) 339 residues
LSRTGVSKKP KLTAPVVIIG TLVLLIIAFT ASLMLGPVTV PLNELATNPV VTDIRAPRII
IAALVGAALA VSGAIMQTVF HNPLADPGIV GVSSGAAVAA VLAIVTGASF FGQWTVPFAA
FVGALVTVAV VYLIASSRAM DGRGADPATL VLVGMAITAF LGAVISSATA NAPQDSELRS
VTFWLNGDLV SRTWEHVGVA IIPIIVGLIL AIGGSRDLNL LLLGDSTAQT SGLNVNRARI
ILLALAALLT ATAVAVSGTI TFVGLVVPHL VRIVLGADHR ALLPAAAILG ATFVIVSDTV
ARMIFSPIVL QTGVVVAFIG SPIFLYLLLS MRKRRGLGL > RXA02900 (1-852, translated) 284 residues
MSNPAASTPA NNSDDVAKEN WDSSFTPKTD IDSSQPVNNS TGEAAARAVN LYKAYGQGDT
TVTALDHVNV EFEKNKFTAI MGPSGSGKST LMHCMAGLDA ATGGSAFIGD TDLSRLKDKE
MTSLRRDRLG FIFQSFNLVP TLTASENITL PTDIAGRKID QSWFDEITSR LGLTERLKHR
PAELSGGQQQ RVACARALVS RPEIIFGDEP TGNLDSNSSR EVLDILRTAV DQDDQTVVIV
THDAKAASYA DRVIFLADGR IVNQLFDPTI EEILATMNGI EDIA >RXN00024 TRANSLATE of: rxn00024.seq check: 2799 from: 1 to: 945
MEHGVTVIKGTEFDVFPLNLGGNTFGWTSNREQTFAVLDAFVAAGGNFVDTADSYSAWVE
GNEGGESERELGAWIKERGADKLIIATKSGALEPVAGRSREATFKAVEGSLERLGVESID
IFYYHYDDEAVSIDEQVAIANDLIAQGKIKHLALSNYSAERLAEFFEKSVGTPAQPVALQ
PHYNLVSRKDYEENVQPLAEKHGVAVFPYFALAAGLLTGKYTSKEDISGKARAGQLDRYA
SDEAFAVVTELRAVADELGVAPTTVALAWLVAHGVTAPIASVSKVEQLKDLMAVKDVELS
AEQLARLDKVSEPFA >RXN00092 TRANSLATE of: rxn00092.seq check: 5543 from: 1 to: 666
MTNTPFPLELQNISCAFGEGPRHVSALNNVSLAVNPGELVAIMGPSGSGKSTLLNVAGLL
QRATSGHVLIDGASASDLNAKRAAETRRRHIGVIFQNYNLVPTLTVGENVGLPLELDGKT
DRQAVAIALAEVGLEGFDDRFPEEISGGQAQRVAIARALIGPRKILLADEPTGALDTSTG
```

Appendix B, page 24

```
DAVLRVLRQRIDSGAAGLLVTHEPRFAAWADRTIMLRDGEIQ

>RXN00099 TRANSLATE of: rxn00099.seq check: 3872 from: 1 to: 1173
VKNPRLIALAAIILTSFNLRTAITALAPLVSEIRDDLGVSASLIGVLGMIPTAMFADAAF
ALPSLKRKFTTSQLLMFAMLLTAAGQIIRVAGPASLLMVGTVFAMFAIGVTNVLLPIAVR
EYFPRHVGGMSTTYLVSFQIVQALAPTLAVPISQWATHVGLTGWRVSLGSWALLGLVAAI
SWIPLLSLQGARVVAAPSKVSLPVWKSSVGVGLGLMFGFTSFATYILMGFMPQMVGDPQL
GAVLLGWWSILGLPLNILGPWLVTRFINCFPMVVIASVMFLIGNGGFCLAPDVAPWLWAT
LSGLGPLAFPMALTLINIRAETSAGASALSSFGQGLGYTIACFGPLLTGFIVDATGSFRT
IFVLFAVATLFVIRGGYFATRQVYVEKLLNR >RXN00113 TRANSLATE of: rxn00113.seq check: 9363 from: 1 to: 5622
VRIVLTTEGEVAAKLVTRFAIRGRITTNEMAAPADSYGARDEVVEATPRSFIRQATVSAP
ADMTPFAMVSGDYNPIHTSDNAAKLVGLDAALVHGMWLSATAQHLAGLGSEVIGWTYSMY
GMVQLNDVVDITVERVGRAGLKPAYEVTCRIDGNVVSRGQALLKAPSTAYVYPSQGIQAK
GMGQGDRTASAEARAVWERADAHTRANLGFSIQQVIDENPTELKVGDTTFVHPAGVLNLT
QFTQVALAVVAYAQTERLKAANAIVDGSLYAGHSLGEYTALASLGNIFELEGVIDVVFSR
GSAMHSLVPRDEKGRSNYGLAAFRPNMINVAATEVENWVDRVAEESGEFLQIVNYNVDGQ
QYAVAGTLAGLKALKASASANPRAYVNIPGIDVPFHSSVLRPGVPAFAEKLDELLPETID
IDALRGRYIPNLVARPFELTQSFVDAILAVVPSERLKGIKVEDTDENTLARLLLIELLSW
QFASPVRWIETQALIIDTVDQIIEVGLAASPTLTNLALRTMDVIGKSRPVFNVERDQDTV
MLNDVRQAPVAEVEEEAVEEAPAAAAAPAAEAPVAAAPVAAAAPAPVGNAPELKFNAANA
IMVLFAVQNKINIDQITAADTSETLTNGVSSRRNQMLMDMSTELSVPTIDGAADADVATL
QGRVVTAAPGYKPFGPVLSETVRARLRALTGAAGLKTSYIGDRVTGTWGLPESWTAHVEV
ELLLGTREGESVRGGNLGSLPANASSKGDVDALIDAAVQNVAAANGTSVSMSSGGAASGG
GVVDSAALDAYASTVTGEEGVLANVARGILSQLGLDTKDEVEGAEIDTELYDAVEAELGT
GWLKLVTPVFSADRAILFDDRWASAREDLARLANGEDIAVERFAGTGETVVKQAAWWAEH
VEDTALAATLKQVSEVAAKPANEPHIDDVALVTGAAPESIAGAVAARLLSQGATVILTAS
NVSQARKEYARKLYAANATPNAKLWIVPANMSSYRDVDAVIDWIGNEQRVTVGSTVTVTK
PALTPTLAYPFAAPSVSGTLADAGPQAENQARLLLWSVERTIAGLADLASRGVDGRVHVV
LPGSPNRGMFGGDGAYGEVKAAFDAILAKWGSETGWPQFVSLAQARIGWVAGTGLMGRND
VLIPAAEKLGIHVYTPEEISSELLGLASAESREKALEAPIDYDLTGGLSGGVSIAALAAS
LESDAVETTSAAEDTIKALPSPKHPEQPVGTPVGEVKTDLEDMVVMVGVGEVSSWGSGRT
RFEAEYGIQRDGSVDLTAAGVLELAWMMGLISWSEDPKPAWYDADGTEVPEEEIYERFRD
EVIARCGVRELVDDAFLVDGGSLDAAEVFLDRDISFSVTSAEEAQAYVDADASVTVEEAD
GEWIVTKKKGSTSFVPRKATLTRSVAGQLPTDFDPAKWGIPASMIDALDNIAAWNLVTAV
DAFLSSGFSPAELLQSIHPADVSSTQGTGIGGMQSLRKLFVNRFLGQDRPSDILQETLPN
VVAAHTMQSYVGGYGQMIHPVAACATAAVSVEEGVDKIRLNKADFVVAGGIDDIQVESLT
GFGDMNATADTQAMLDKGIDPRFISRANDRRRAGFLEAAGGGTVLLARASVAAELGLPVL
AVVAHAQSYADGAHTSIPAPGLGALGAARGGKKSVLARELNKLGLTPDDVRVVSKHDTST
NANDPNESELHNLLWKTIGREADNPMFVVSQKSLTGHSKGGAALFQIGGLVSILETGKLP
QNASLDCVDPEMEAKGENFVWLRKPLDLGAGSIKAGVLTSLGFGHVAAVVVLATSGIFEQ
AMRNAGLDVEAWRARATQRLRTGANRLEAGMVGRAPLFEQVDGRRLPEHGAHQAEINLLI
DADARLGADGIYQG >RXN00164 TRANSLATE of: rxn00164.seq check: 2228 from: 1 to: 1689
VGRIPRAKWWFLGALVLLSAGAYASVLVPQVLGRIVDLVSDGAQMRDFVELSVILIAVAI
AGAVLSACGFYVVSRISEKIIANLREDMVGTALGLPTHQVEDAGSGDLVSRSTDDVSELS
AAVTETVPILSSSLFTIAATIIALFSLDWQFVLIPVVVAPVYYFASKHYLSKAPDRYAAE
RAAMAERARKVLEAIRGRATVRAYSMEDAMHNQIDQASWSVVVKGIRARTTMLILNMWML
FAEFLMLAVALVIGYKLVIDNALTIGAVTGAVLMIIRLRGPMNMFMRVLDTIQSGYASLA
RIVGVVADPPIPVPDSGVKAPQGKVELRNVSFSYGDSWAVKDIDITINSGETVALVGASG
AGKTTVAALLAGLRVPDQGQVLVDDFFVSHLSDRERIARLAMVSQEVHVFSGTLRQDLTL
AKPDASDEELAHALGQVNALDWLESLFEGLDTVVGARGIQLEPVVAQQLALARVLLLNPA
IVIMDEATAEAGSAGASALEEAADAVSKNRSALVVAHRLDQASRADQILVMDKGEVVESG
THQELLDHGGIYQRLWTAWSVGR >RXN00193 TRANSLATE of: rxn00193.seq check: 1918 from: 1 to: 594
KAFXQREGFISAFGFTVLVVIVSVITVNIFAFLLAWLLTRKLRGTNFFRTVFFMPNLIGG
IVLGYTWQTMINAVLSHYATTISADWKFGYAGLIMLLNWQLIGYMMIIYIAGLQNVPPEL
IEAAELDGVNKWEMLRHVTIPMVMPSITICLFLTLSNSFKLFDQNLALTNGAPGGQTEMV
```

Attorney Docket No.: BGI-125CP

ALNIINTLFNRMNVEGVG

>RXN00201 TRANSLATE of: rxn00201.seq check: 716 from: 1 to: 192
VADCGLPIPEHVEIIDLALVFGIPTFEQVLNALKPEVVVEGAVIAEGAPQRIREMVDTDV
EVCA >RXN00243 TRANSLATE of: rxn00243.seq check: 3186 from: 1 to: 1017
VTSEQALDPIHPGQFRLSRIQLINWGTFHGTVDIPVTREGILVTGGSGSGKSTLIDAITA
VLLPQGKLRFNSAAQANTPRNKGRSLVTYIRGAWRAQEDPLQDQIVSTYLRPRATYSLVG
LTYSNGEGVEHTLVAIFYLKSGHNLTSDISSYYGVFPVDQDINALLDFLKEGIDKRQIRA
AFKEAIFSEQHSVFSGRFRSRLGISSEEALLLLHRAQSAKDLQSLDDLFRDYMLVEPDTF
SIAKTAVEQFQDLEGAYEQVEDIKRQIHTLDPLVQLKNRREKAQQSKDHANALKKALPTV
GNRIKKEEQEPLVRQFTVEQTQRSRRWSPPKLRQIVPAK >RXN00297 TRANSLATE of: rxn00297.seq check: 2827 from: 1 to: 912
MGFTVVFIVIGIGWILGRRDTLGTHAQKPLSLFVYYVATPALLFDRVTKSDTSTIFSLNF
VVIALSALIVGFLFFLLMRFVIKRTAAVSVIGMLAASYANAGNLGIPLAAYILDDFTVVI
PVILFQVAFYAPITMTIMEMLTNKKSTNLVRNLLVTPLTNTMVLAAIAGIAVSLTSMSVP
VVIAQPVEMLANASVPLALVVFGLSLSKSKILEKGQVSRRDVFTAALFKNVLHPIVAGLL
ALAFGMEGTALLSAVILGALPTAQNVYTYALRFRTAESMARDTGVVTTLISFPVLVAVSI
IFGS >RXN00298 TRANSLATE of: rxn00298.seq check: 2826 from: 1 to: 1845
MSSNIAITTEPEGKNKKGLKSDPFIFSISVGFIVVFVIATIALGEKARTTFSAIAGWLLE
NLGWMYIGGVSLVFIFLMGIFASRYGRVKLGDDDDDPEHTLIVWFCMLFAGGVGAVLMFW
GVAEPINHAFNVPMANEESMSEAAIVQAFAYTFYHFGIHMWVIMALPGLSLGYFIYKRKL
PPRLSSVFSPILGKHIYSTPGKLIDVLAIVGTTFGIAVSVGLGVLQINAGMNKLWSTPQV
SWVQLLIILIITAVACISVASGLDKGIKLLSNINIAMAVALMFFILFTGPTLTLLRFLVE
SFGIYASWMPNLMFWTDSFQDNPGWQGKWTVFYWAWTICWSPYVGMFVARISRGRTVREF
IGGVLALPAIFGVVWFSIFGRAGIEVELSNPGFLTQPTVVEGDVPAALFNVLQEYPLTGI
VSAFALVIIVIFFITSIDSAALVNDMFATGAENQTPTSYRVMWACTIGAVAGSLLIISPS
SGIATLQEVVIIVAFPFFLVQFVMMFSLLKGMSEDAAAVRRVQTRQWEKTDTPEKLEEHS
SQPAPGYDDEGNPLPMPALEHDEDGNIVIPGNVVIEGDLGVVGDVVDDPEEAQEMGSRFK
IVEQTRPQSRDEYDI >RXN00349 TRANSLATE of: rxn00349.seq check: 102 from: 1 to: 1467
MLSFATLRGRISTVDAAKAAPPPSPLAPIDLTDHSQVAGVMNLAARIGDILLSSGTSNSD
TKVQVRAVTSAYGLYYTHVDITLNTITIFTNIGVERKMPVNVFHVVGKLDTNFSKLSEVD
RLIRSIQAGATPPEVAEKILDELEQSPASYGFPVALLGWAMMGGAVAVLLGGGWQVSLIA
FITAFTIIATTSFLGKKGLPTFFQNVVGGFIATLPASIAYSLALQFGLEIKPSQIIASGI
VVLLAGLTLVQSLQDGITGAPVTASARFFETLLFTGGIVAGVGLGIQLSEILHVMLPAME
SAAAPNYSSTFARIIAGGVTAAAFAVGCYAEWSSVIIAGLTALMGSAFYYLFVVYLGPVS
AAAIAATAVGFTGGLLARRFLIPPLIVAIAGITPMLPGLAIYRGMYATLNDQTLMGFTNI
AVALATASSLAAGVVLGEWIARRLRRPPRFNPYRAFTKANEFSFQEEAEQNQRRQRKRPK
TNQRFGNKR >RXN00368 TRANSLATE of: rxn00368.seq check: 9416 from: 1 to: 1575
MRLGVWLIVAGLFITPLALVVGLALGGNQFPALWDSGLGKALWNSAYTTVLSAVGATIIG
TIMALTLDRTDVFGRTALRLFLLSPLLIPPFIGAIAWLQLFGKNQGINRFFGTEVWDIYG
ADGVTFLLIVHSYPTVYIIVSSAALRQLPSDLEQAARIAGADTFTVLRTITLPLLKPALLS
AFTLTTVANLADFGIPALLGSPARFETLATMIYRFMESGTVSNPLQVVSTIGIVLLFLGI
AAVTADYLVSLYAASKLQDAGTPHRFTLNKSRIPVSVITWIIALIITAAPLLGLAYRALL
PAPGVPFNLDNITLNNFEAALSNPRVIEGFSNSLMLSLGAALICGVLGWLIGVLITRTQH
FANVPLTLTVLLPTALPGMIIGVGWLILGRYTGIYNTPWVILGAYVCAFTALVVQAVRGP
LSQAPEAIEEAARISGAGRLRSIMDTTGAMAIPAAFAGAVLVAVTAVRELTVSILLIAPG
TTTLGVQVFNLQQAGNYNQASALSLMFAIIGIVALALTVRSQKEF >RXN00378 TRANSLATE of: rxn00378.seq check: 9591 from: 1 to: 2610
VDKAVNTAISDAKTAALKAGVGLNRATASEEEEDLSSSIKVSLAFELEGLSNAPSLMVVE
KALEKIPGVSADLIYPSQTAWITATDRVHPETLIEVFEQFGIKAHLSNSSLLRRHQQLSA
EVNREARLDRYRSRMDAKRISPRVRRHNRQEMVHAVRARESGWIKRRNHTTSQHEDPMSG Attorney D et No.: BGI-125CP

```
DVLFTARALITPKRLWVSLPFALIVLALSLNPSWQFDYWQWLSAVLAIPVVVWGAWPFHR
AAAGGIRRGISALDATSSIAIAAAYAWSIAMLLFETPGGKSWRSYPSWFAFDHGTLTQNE
IYFDVACGITVLLLAGRLLTRRRSQSSLLAELGRLQIDPQRIVTVVRKHRLKRVVQELNI
PVQEVRVNDDVKVPPNTTIPVDGTVIGGGSRIAASIIMGQDQRDVKVNDKVFAGSLNLES
EIKVRVIRTGHRTRIAAVHRWVKEATLKENRHNRAAIRSAGNLVPITFTLAVVDFCLWAL
ISGNINAAFTTTLAVLACVAPVALALSAPLATRNSIEAAARHGILVRSGEIFRVLDDVDT
AVFNRVGTLTDGEMTVETVTADKGEDPELVLRVAGALAMESHHAISKALVKASREARDTG
AGGGEDVPHWIEVGNVEITEAGSFQATIELPLIKPSGEKIMRTTEALLWRPRSMTEVREHL
SPRLVAAATSGGAPLIVRWKGKDRGVITLSDHVRSDSSDAIIAIEEQGIETMMLSRDTYP
VARRYADSLGITHVLAGIAPGKKAQVVRAVHTRGSTVAMIGDESVMDCLKVADVGVLMGV
DRPSDLRDDSDDPAADVVVMREEVMSVPTLFKLARRYAKLVNGNIALAWIYNGVAMVLAV
SGLLHPMAATVAMLASSLLIEWRSGRARKY

>RXN00410 TRANSLATE of: rxn00410.seq check: 1977 from: 1 to:  666
MMIYGKGSTEVRALDGISVQIQSDKWTSIMGQSGSGKTTLLQCLSGLAQPTSGRVTLNKN
NITLSSLSENKRAKLRRTHISMVFQDFNLVPILSVKDNILLPLRLAHRRVDKQWFEHITS
VLKIDNRMRHLPGELSGGQQQRAAIARALMSRPDIVIADEPTGSLDSVTSDAVLNLFRSI
VDDFGQSLVFVTHDKDAAHRGDVLITMRDGKIIDTADLRVGR >RXN00411 TRANSLATE of: rxn00411.seq check: 5242 from: 1 to:  675
MNEMILAADWNRLGPTFQTAIIDTLLMVIITMVVAGLLGLVVGLLLYTTRAGGILKNKVI
YTILNVLVNFVRPIPFIILIAAIKPLTVAVMGTSIGRDAGIFVMVVAAIFSVARIVEQNL
VSIDPGVIEAARSMGASPMRIIATVIIPEALGPLVLGYTFLFIAIVDMSAMVGYIGGGGL
GDFAIVYGYRAFDNEVMYVAVLVIVIIVQAAQLLGNWLSKKIMRR >RXN00412 TRANSLATE of: rxn00412.seq check: 7568 from: 1 to: 1080
VSHTASTPTPEEYSAQQPSTQGTRVEFRGITKVFSNNKSAKTTALDNVTLTVEPGEVIGI
IGYSGAGKSTLVRLINGLDSPTSGSLLLNGTDIVGMPESKLRKLRSNIGMIFQQFNLFQS
RTAAGNVEYPLEVAKMDKAARKARVQEMLEFVGLGDKGKNYPEQLSGGQKQRVGIARALA
TNPTLLLADEATSALDPETTHEVLELLRKVNRELGITIVVITHEMEVVRSIADKVAVMES
GKVVEYGSVYEVFSNPQTQVAQKFVATALRNTPDQVESEDLLSHEGRLFTIDLTETSGFF
AATARAAEQGAFVNIVHGGVTTLQRQSFGKMTVRLTGNTAAIEEFYQTLTKTTTIKEITR >RXN00419 TRANSLATE of: rxn00419.seq check: 8218 from: 1 to:  759
MLNAVGKAQNILLLGGTSEIGISIVSRFLKQGPSHVTLAARKDSPRVDAAVAEIKAAGAA
SVAVVDFDALDTESHPAAIDAAFENGDVDVAIVAFGILGDNEAQWRDQALAVEATTVNYT
AGVSVGVLLGQKFEQQGHGTIVALSSVAGQRVRRSNFVYGSAKAGFDGFYTQLGEALRGS
GANVLVVRPGQVRTKMSADGGEAPLTVNREDVADAVYDAVVNKKDIIFVHPLFQYVSFAF
QFIPRAIFRKLPF >RXN00432 TRANSLATE of: rxn00432.seq check: 8334 from: 1 to: 1485
MELLETFITDVINDNLWMILPFLLVAAGLYFGGRTLLVQIRMIPEMFKAVVEKPAKDGEF
ADKQDISAFKAFTISAASRVGTANVAGVALAITLGGPGAVFWMWIIALVGGATSFIESTL
GQLWKVKDGDSYRGGPAYYMTLGLNARWLAVVFGVAITLTFGFVYNALQSNAVVEAITVS
LGTPSTTAKAFVGLGMAGLSALVIFGGVQRIANVTQWMVPFMAGAYIIVGVVVIVINIQQ
VPTMINDIIAGAFGFRPVATASVWGAFWLAFMNGMRRGLFSNEAGEGSVPNAAATATVSH
PVKQGLVQTLGVYFDTLLVCSITAFVILLSGVEYATGDIQSSSLTQSALASVVGGWGTHF
ITVVMFFLAFSSVLGNYYLAQANIQYFTDSKTVMTVFRLLVLLSVFSGAVASVPLIWALG
DTFAGIMVLINLAAIIPLGGVAVKLLKNYTIQKKAGLDPVFHRDMMPEVRNIACWNGKDA
ATSNYHEAMEVIKKS >RXN00443 TRANSLATE of: rxn00443.seq check: 5344 from: 1 to:  804
VNKSIRRALYSFITISAGISLVACSSSDTASTTTQNASATEAAGVSGTASVFAAASLTNV
AEDLAAAFNEDNPDAKLEFNFAGSSALVRQISEGAPSDLFISADIANMDDALALPEFAGA
TSKVIATNKLVLVTADGNPGEISELADVKDSLVAICAPEVPCGTITHEALDYADIELNTS
SEEANVADVATKISTGAVDAGFVYQTDAQSLAKTQDNTVIELEGIDANEYPMALTTTGED
NEVAKAFAEFLSSDRAKEILASYGFGTN >RXN00444 TRANSLATE of: rxn00444.seq check: 7535 from: 1 to:  837
MVLAQTKKARRSENHILPGWLLIPATLAMLLIIGPIFALLLQIPWDRSWELLTAPESLGT
ARLSIGTALFSTALCAIVGFPLALALHLYERSHPRVTSVLTVLVYAPLVLSPVVSGLALT
```

Appendix B, page 27

Attorney Docket No.: BGI-125CP

```
FLWGRRGFLGSWLDQVGLPIAFTTTAVVFAQVFVALPFFISTVTTALRGIPKQFEEIAAT
EGATRWEIMHKMIIPLAMPGIFTGMILGFARALGEYGATLTFAGNIAGVTRTIPLHIELG
LSSNDMDKALGAVIMLLAVYVLIIGAIGALRLFSKVRKV

>RXN00449 TRANSLATE of: rxn00449.seq check: 92 from: 1 to: 1581
MSTPDIKEGSAESPGEVMVVGDRREWRRQATGIIAGLVLAALVYLLFPSNSVETVMQSSG
VDPETEYTNNAMRLTAAVTILMAVWWMTEAIPLAATALIPLVAFPAFQVVDFGKATAPYA
NPTSFLFLGGFLMALGLQKWNLHRRMALAVVLAVGTKPKQLVLGFMVATGFLSMWVSNTA
TAVVMLPIGMSVLALTAETVGGMKNQKKFATGLMLSIAYSASIGSLGTLIGTPPNALLAA
YMSESHDIHIGFGQWMILGVPIAVVFTIIAWLVLTTVFKPEMKEIPGGRELIKREIAEMG
PWTAPQVTVGVIFAAAALAWVFIPLTLDWTGSQLSINDSLIGIAAGLLMFIVPANFKTGE
RILDWRTAGELPWDVLLLFGGGLSLSAMFTSTGLSLWIGELAKGLDALPIFILIFAIAVL
VLFLTEFTSNTATAATFLPIMGGVAVGIGLTAGGEQNVLLLTIPVALSATCAFMLPVATP
PNAIAFGSSGYIKIGEMVKGGLWLNIIAVILITIFTYFVAIPLFGIML >RXN00456 TRANSLATE of: rxn00456.seq check: 2097 from: 1 to: 1377
VLQALLAIMVSLSVAAILEGNRALVGLLLATTLGLGVAQWIQKVVAEDLGQHYVHEVRRE
LVGAALVPGNTASLGVTVTRASNDLTAVRNWVALGIVPMVTGLPLIAIVLVALFIQDLRT
GVAVTVPLLMCVAVLPVVARWTLKRARELRKKRGRMAARIADSVMAGELLHATGAIDREL
NAVTRDSDRVVIAAVRRSWATGFSRALMAMAASLGTVSIVISGHLEVSEVAGIMMLLGVL
ATPVAELGRVVEYRQNYKAATRILIPLLQRGSEFKHSQQKLPGLQATEGIPGVYVKGISA
LPGERIYLHGSADATRKWVTSLSAMEEGTDVIVNGQRLSQLPLKQRRALIGIASAHHHLS
RGSVSRLVGLRVPDATVEEIEQALEQVGLNNTGKQRLKNGGHPWSTSQINKLKIASATLR
TPPLLVLEGITPENLLNYPGVIISTVQENPSETWRQVNI >RXN00466 TRANSLATE of: rxn00466.seq check: 8825 from: 1 to: 996
VQSRLSKILRSSVVGVAVLALLAGCSNNADDTDADSTSTGNSAFPVSIEHEFGTTTIDDV
PERVVTLGVTDADIVLALGTVPVGNTGYKFFENGLGPWTDELVEGKELTLLDSDSTPDLE
QVAALEPDLIIGVSAGFDDVVYEQLSDIAPVVARPAGTAAYAVAREEEATNLVARAMGQSE
KGQELNEETDALIQAARDENPSFDGKTGTVILPYQGKYGAYLPGDARGQFLDSLGISLPE
AVLSRDTGDSFFVDVPAESVKDVDGDVLLVLSNDENLDITAENPLFETLNVVQKDAVIVA
TTEERGAITYNSVLSVPFALEHLAPRIAEALK >RXN00477 TRANSLATE of: rxn00477.seq check: 7063 from: 1 to: 1644
MKVSTKTPRSSGTAVVIGAGVAGLATSALLARDGWQVTVLEKNTDVGGRAGSLEISGFPG
FRWDTGPSWYLMPEAFDHFFALFGACTSDYLDLVELTPGYRVFSGTHDAVDVPTGREEAI
ALFESIEPGAGAKLGNYLDSAADAYDIAIDRFLYNNFSTLGPLLHRDVLTRAGRLFSLLT
RSLQKYVNSQFSSPVLRQILTYPAVFLSSRPTTTPSMYHLMSHTDLVQGVKYPIGGFTAV
VNALHQLALENGVEFQLDSEVISINTASSRGNTSATGVSLLHNRKVQNLDADLVVSAGDL
HHTENNLLPRELRTYPERYWSNRNPGIGAVLILLGVKGELPQLDHHNLFFSEDWTDDFAV
VFDGPQLTRPHNASNSIYVSKPSTSEDGVAPAGYENLFVLIPTKASSSIGHGDAYMQSAS
ASVETIASHAINQIATQAGIPDLTDRIVVKRTIGPADFEHRYHSWVGSALGPAHTLRQSA
FLRGRNSSRKVNNLFYSGATTVPGVGIPMCLISAENIIKRLHADTSAGPLPEPLPPKTTP
SQKTSYDH >RXN00523 TRANSLATE of: rxn00523.seq check: 9218 from: 1 to: 1026
MSLSHQLKRQRASRNSRRWLIVAALGVVTLGIFAFSLMWGEVFYGPAQVLKVLSGQQVPG
ASYSVGVLRLPRAVMGLTAGLAFGAAGVIFQTVLRNQLASPDIIGISSGASAAGVICIVF
FGMSQSAVSAISLCASLAVALLIYLVAYRGGFSATRLILTGIGIAAMLNSLVSYSLSKAD
SWDLPTATRWLTGSLNGATWDRAMPLIVTTVVLIPLLVANARNVDLMRLGNDSAVGLGVA
TNRTRVIAIIAAVALIAVATAACGPIAFVAFVSGPIAARILGSGGSLIIPSALIGGLIVL
IADLIGQYFLGTRYPVGVVTGAFGAPFLIYLLIRSNRAGVTL >RXN00525 TRANSLATE of: rxn00525.seq check: 5915 from: 1 to: 1263
MSLAESILLALTSLRSNKMRALLTLLGVIIGIASVIGILTIGKALQDQTLNSLESLGAND
LSAQVEERPDEDSPEPDMFAFSGAANSSGNLIPEETVDTLRDRFAGSITGISVGGMGTQG
TLIGDTADLKSDLLGVNEDYMWMNGVEMNYGRAITQDDVAAQRPVAVIAPDTFNTLFDAN
PNLALGSEVAFELNGQETFLRVIGVYKEAAAGGLVGSNPTVHTYTPYTVANDITHTEDGL
NTLSIRAAQGVDQDSLKGSLQTYFDALYANNDSHHVAMLDFRKQIEEFNTILGAMSLGIS
AIGGISLLVGGIGVMNIMLVSVTERTREIGVRKALGARRRDIRLQFVVEAMIICFIGGIL
GVLLGGILGLIMSSAIGYISLPPLSGIVIALVFSMAIGLFFGYYPANKAAKLDPIDALRY
```

Appendix B, page 28

Attorney Docket No.: BGI-125CP

E

>RXN00559 TRANSLATE of: rxn00559.seq check: 9522 from: 1 to: 1017
MSDNPHENPRENPHRSPEVVLRFMAAPTDVLMAGSHGVGGGRVLEWIDKAAYACATQWSG
TYCVTAYVGHIHFTRPIPSGHMVEVRSRIAMTGRSSMHIVNEVLSADPRDGNYTRACDCL
VIFVAKDTATGRATPVPSFTPKNEEEQRVLEAANSRIGLRKAIEAEMEKQTYNGPSEAPR
LITRFLAKPTDINWGGKVHGGTAMEWIDEAGAACTMEWSGNHTVAVYAGGIRFYQPIQIG
DLIEVDARMMRTDKRSMQMSIHVRAGDAHRGRAELETAIHATVTYLGIDVDGEPLPAPQF
VPRTPEDIQLAEHANILRDLRADYTPMPLFQRRVPLQID >RXN00563 TRANSLATE of: rxn00563.seq check: 2005 from: 1 to: 2739
FYKDLYARSARGTAALWIVAANLSSYSDIDAIINWVGSEQTTTVNGASKLVKPALVPTLL
FPFAAPRVSGSMADAGPQAESQMRLLLWSVERLIAGLAPLGSSINVGHRLHVVIPGSPNR
GRFGGDGAYGESKAALDAVVTRWNAEQAAWGAHTSLVHAHIGWVRGTGLMGGNDPLVKAA
EEAGVETYSTQEIAEKLLSQATSTVREQAASAPITVDFTGGLGESDLNLAEMARAEAAKA
ANAPVVEAPRTVAALPTPYRPVVQTTPDFAGQVTQNLDEMVVIVGAGELGPLGSARTRFD
AELNGSLSAAGVIELAWTMGLIHWDEDPKPGWYDDSDDAVAEEDIFDRYHDEVMARVGVR
KYNDMPEYGMIDNFAPELTTVYLDQDLTFNVGSREEALTYVDSEPELTFASFDEAAGEWK
VTRKAGSAIRVPRRMAMTRFVGGQVPKDFDPAVWGIPADMVDNLDTVALWNIVCTVDAFL
SAGFTPAELLASVHPARVSSTQGTGMGGMESLRGIYVDRILAEPRANDVLQEALPNVVAA
HVMQSYVGGYGQMIHPVAACATAAVSVEEALDKIRIGKSDFVVAGGFDALSVEGITGFGD
MAATADSAEMEGKGIEHRFFSRANDRRRGGFIESEGGGTVLLARGSLAADLGLPVLGVIG
FAESFADGAHTSIPAPGLGALGAARDGVESRLAVALRSVGVSADEISIISKHDTSTNAND
PNESDLHERIASAIGRADGNPMYVISQKSLTGHAKGGAAAFQMIGLTQVLRSGLVPANRA
LDCVDPVLSKHSHLVWLRKPLDLRAKAPKAGLVTSLGFGHVSALVAIVHPDAFYEAVRVA
RGAEAADVWRASAIAREEAGLRTIVAGMHGGVLYERPVERNLGVHGDAAKEVEAAVLLDS
RARLVDGVLRAEG >RXN00570 TRANSLATE of: rxn00570.seq check: 2677 from: 1 to: 852
TRPRPQEIGNGLVALIFSASGPIAVILAAAAAGNLSPDQTSSWIFGAFLGNGLLTLWLTY
MYRSPQAYFWTIPGTVIVGDSLTHLSFAEVIGAYLVTGVVVFALGWTGLIGRIMAVLPPT
IVMAMVAGIFLRFGLDLIDASVTDPLIALPMVIVFVALSMSPRLASIAPPVAVAAVVGTI
VAIASGKLASGILDNGIISRPVFTAPEFSFAAIMELVVPLAITVVIVQNGQGVAVLKAAG
HRPGVNLAAAASGLWSLPMALIGNITTCLTGPTNALIVAGAKSH >RXN00571 TRANSLATE of: rxn00571.seq check: 33 from: 1 to: 1257
TLVPQVYEIVIYGAVLSAVHEDPTQIGALSPAVAGTLGSYAMIGVMIGALSAGAVGDRLG
RRKVMLTAIVWFSVGMALTAFASSIALFGFLRFLTGLGVGMIVATGGAIIAEFAPANRRN
LFNAIVYSGVPAGGVLASILALLFEDVIGWRGLFLIGGSPLLFLLPLAYFFLPESPRWLT
SRGRAADAKALCARYGLPTEEFVVEKQQETKGTGFAGIFSSKYLMGTILIGAMSFIGLLS
TYGLNTWLPKIMESNGATSHDSLYSLLFLNGGAVFGGLIASWFADRIGAKTVITSTFALA
AICLGVLPNISSWPMMYTAIAFAGVGVLGTQVLTYGLTSNFFGTECRAAGVAWCAGFGRL
GGIVGPAIGGLIIGAGFGPSSAFLIFAAAAAIGAVCTLLIPRSPAEVEVKVAQEPLARV >RXN00590 TRANSLATE of: rxn00590.seq check: 3570 from: 1 to: 1188
MADNKNADDSQLVSASTGTPGPGDIAKANAPSLKQAAVTASGRSALMGAIFLMATSAIGP
GFLTQTAVFTNQLGAAFAFAILVSILIDIAVQLNVWRIIGVSEMRAQELGNTVIPGFGWV
LAVLVCIGGVVFNIGNIAGGGLGLNALLGWDVKVGGVITAAIAIAIFLFKRLGAALDKFL
VVLGVVMILLTVYVAFVSQPPVGSALKNAVLPDTIDWLVITTLVGGTVGGYITYAGAHRM
LDSGRTGPNNVKAVSNSSITGILITGLMRVVLFLAVLGVVAGGVTLSTTGNPAAEAFQHA
AGDIGLRIFGAVLWAASISSVIGASYTSATFLVENKPEKKRLQNWVTIIFILISCSVFIM
LGTAPAILLVFAGAFNGLVLPVGFTLMIYVAIFRQK >RXN00661 TRANSLATE of: rxn00661.seq check: 3591 from: 1 to: 690
MNPITELLDATLWIGGVPILWREIIGNVFGLFSAWAGMRRIVWAWPIGIIGNALLFTVFM
GGLFHTPQNLDLYGQAGRQIMFIIVSGYGWYQWSAAKRRALTPENAVAVVPRWASTKERA
GIVIAAVVGTLSFAWIFQALGSWGPWADAWIFVGSILATYGMARGWTEFWLIWIAVDIVG
VPLLLTAGYYPSAVLYLVYGAFVSWGFVVWLRVQKADKARALEAQESVTV >RXN00733 TRANSLATE of: rxn00733.seq check: 1945 from: 1 to: 885
MSNTAGPRGRSHQADAAPNQKAQNFGPSAKRLFGILGHDRNTLIFVIFLAVLSVGLTVLG Appendix B, page 29

Attorney Docket No.: BGI-125CP

```
PWLLGKATNVVFEGFLSKRMPAGASKEDIIAQLQAAGKHNQASMMEDMNLVPGSGIDFEK
LAMILGLVIGAYLIGSLLSLFQARMLNRIVQSAMHRLRMEVEEKIHRLPLSYFDSIKRGD
LLSRVTNDVDNIGQSLQQTLSQAITSLLTVIGVLVMMFIISPLLALVALVSIPVTIVVTV
VVASRSQKLFAEQWKQTGILNARLEETYSGHAVVKVFGHQKDVQEAFEEENQACV

>RXN00784 TRANSLATE of: rxn00784.seq check: 3499 from: 1 to: 735
MSIEFSAPAKMKIEVWSDIMCPFCYIGKKRLDDALSTFDQAGRIEVEYKSFELMPGLETH
PLRSDVEYLADAKGMSLEQARQMNGQVQAMAQATGLEMNPDETIAANTINAHRLTHFAKA
HGKQQEVAQELFKAHFVDGKNVDDLDVLVSIAAEVGLDASAAREALESDVYTNEVQQDVH
EARQLGVQGVPFFVFDRKYAINGAQQEEVFTGTVEKAFEEWAAENPVSPFEVIDGQSCSV
DGTCN >RXN00792 TRANSLATE of: rxn00792.seq check: 6734 from: 1 to: 1197
MSQEILSHFAPALERIRSGAVEREQQRALPVEEIKELVELGFTGLRVPEELGGAGASLES
VVELLIEIAGADSNIAQALRGHFAFVELLLEAPESEFRTHWLREVATGRLVGNAESEKRG
VYGDPQTFIDEVETENGPIFVLNGTKFYTTGTYFADYTWTTALLRNLNGQETLVSLPVDL
HAPGVDVADDWSGFGQKLTASGTTTFKDLEVDPRWIIPRTDAPTLVWTYLQLSLLTVLVG
SAAAAVDEVVARAQSSTRNAWNPGVERRSDPAATIAIGDARSRVTVIRGALLDATRHVSN
AATIVTPEAFNEADAIVAALWPIVSGQALVVTSNVFDAVGASAVLGEHSIDRHWRNVRTV
SSNNPVFLAKNAVGEYALNGTPVGTNIGKALSRPVSLSS >RXN00819 TRANSLATE of: rxn00819.seq check: 3788 from: 1 to: 1329
MRDPIQGAVIPSDLFGFAEVLTEAERAVLLETRRVLEEEVKPYINEAWDKAVFPDEIVQP
LQDLQLLDPPALREAGESVRDIFTGFRNFELARCDINVGTYYNASAGLFRTACMVGGSPE
QAQRLDAQIKSGEVKGVFALTEPDHGSDIAGGLATTATKDADTGEWIINGEKRWIGGAST
ADLIATFARDTADNQVKCFLVAPQAEGVSMEIIDRKASLRIMQNAHITYNNVRVSGDARL
HNINSFKDVSECLRRMRSDVAWMAVGAQAGAYEAAVKYVRSREQFGRPIAGFQLIQEKLA
LMLGNLTASLGMMVKLTDQQQAGIFKEENSALAKMFTSLKLRETASWAREICGGNGIILD
NDVARFHADAEAVYSYEGTHEINALIVGRXILGXLFFLYYXXFEEDLHDYFHHPKPSFLS
KTHQPSPARTWAFRSGALSPRRW >RXN00832 TRANSLATE of: rxn00832.seq check: 2297 from: 1 to: 1050
MPFSWLKPIDYARIFVGWASIFIIPLITLPSIIELALIVAVILFCAFGVVKMAERLAHIL
GDPFGSLILTLSIVIIEVILICAVMLGPADSTTAGRDSVMAVSMIIMGLVVGLCLLIGGL
RHGSMPHNGVGTPTYLVLIATFSVIAFAVPAFRGEYSTGQALVISTLTAVVYGFFLFRQM
GAQAGEFQEVEVAEKADDAAKWEVPFRGLILIITVLPIVLLSHDMATVMDEVLASLGAPV
AMAGLIIATIVFLPETITSLKAAWTGEIQRVSNLAHGAQVSTVGLTIPAVLVIGVITGQD
VVLGETPINLLLLGTTIAVTAIAFSSKKVSAVHGSVLLMLFGVYMMSMFA >RXN00842 TRANSLATE of: rxn00842.seq check: 5448 from: 1 to: 1200
MIIQILRVAFAFVGIIVGAGFASGQEVMQYFVAFGIDGIWGVIVSAVIMSVMALIILQLG
SYFNAGEHGEVFRRVSHPVFSKILDIGVVVTLFSTGFVMFAGAGSNLNQQWGLPLWIGSV
IMVLLVLAAGMLDVDKVTTVIGAITPFIIIFITAASIYTLVGNFSSVEQLDSAALEVGTT
LPHWAVAAVNYVGFNLMVAVSMAVVIGGSMFNPRVAGRGGLLGGLILGFLIIISALTLFA
TVEEVGQDDMPMLTIINNLNPLAGQVMAVVIYGMIFNTALGMFYALGRRLTAKNPQRFRP
VYVVTVLIGFVLSFVGFKNLVGYVYPVLGYIGLLLIAVMMVAWVRGRVRIYKESERRMRI
ADLLQIGHDGALSGAELAVLNQEIQDSNLDEEQIKAAVRK >RXN00931 TRANSLATE of: rxn00931.seq check: 6454 from: 1 to: 846
VKTIEDILTLEEIDRDIYRGPVIESYLARTFGGQVAAQALVAATHTVDKAFTVHSLHGYF
IAPGDPTAPAIYLVDRVRDGKSYVTRSVRGIQDGEVIFSMQASFHRGDEGIEHMDKMRKV
PAPDEIKGTVERMPISSRRVLDEWAEWDIRVIPQDQLELSDFTATEQAVWIRCTADLPDN
PTFHQCSLTYLSDMTLLHSALVPHPGEKMQMASLDHAVWFLRPFRVDEWLLYDQRSPSAS
SGRALTHGRLFNQQGDLVAIVNQEGMTRTLHEGAQSIPMRKD >RXN00934 TRANSLATE of: rxn00934.seq check: 9723 from: 1 to: 1083
VRIGMVCPYSFDEPGGVQAHILDLARTFIAQGHEVQVLGPCSADTQVPDFVVRGGGSIPI
PYNGSVARLSFGPKMFKAVRTFLREGNFDVLHIHEPNSPSFSMAALRFAEGPIVATYHAS
SSGSKLLKAFLPVLSPMLEKVRAGIAVSEMARRWQVEQVGGDPVLIPNGVETSMFKAARQ
IEPNDPVEIVFLGRLDESRKGLDILLRALTRLDRPFTCTVIGGGTPREVAGINFVGRVSD
EEKAAILGRADIYVAPNTGGESFGIVLVEAMAAGCAVVASDLEAFSLVTDSEAAQPAGVL
```

Appendix B, page 30

Attorney Docket No.: BGI-125CP

```
FKTGSDADLAKKLQALIDDPSSRSTLIAAGLKRANAYDWSTVSTQVMAVYETIAIDKVRL
G

>RXN00960 TRANSLATE of: rxn00960.seq check: 4118 from: 1 to: 1035
MARHCCSNRYASTVFSGLIAYGASQALYPWLLKDHQSVTEIDLDAGALQPYFNIEMPPPF
EVMTALLLAFCLGLGMAVIKSDTLFKVTRELERVVMKTITAFVIPLLPLFIFGIFLGMGM
NGGLLEIMSAFGKVLILAVVGTLLFLAIQFIIAGAVSKKNPWKLFKNMLPAYFTALGTSS
SAATIPVTYQQTLKNDVDVNVAGFVVPLCATIHLAGSMMKIGLFTFAVVFMYDMEVGVGL
SIGFLLMLGITMIAAPGVPGGAIMAATGMLASMLGFNTEQVALMIAAYIAIDSFGTAANV
TGDGAIAVIVNKFAKGQLHTTSPDEIEEDDRVAFDITPSDVEHHK >RXN00980 TRANSLATE of: rxn00980.seq check: 2367 from: 1 to: 1794
MLADAFMIAAAIVAGWPIAQSAYQALRIRMVSIDLLVVVAAVGAMFINNYWESAAVTFLF
ALGKALERATMNRTRKALSDLVDAAPETATRLNADDSTEVVELWELEPGDIVLVRNGEQI
PVDGNVIAGVGGIDESNITGESMPAEKGQGSDVYAGTWLRSGVLRVEATGIGSDSTLAKI
IHRVEDAQDDKARTQTFLEKFSKWYTPGVMIAAAVVGLITWDVELALTLLVIGCPGALVI
SIPVSIVAGIGRAARDGVLIKGGEYLETAAKVDVVVVDKTGTLTTGRPELTDVEVIEPAY
SQGEVLELAARAETASEHPLADAIIRGAQDRGLSTTLVEAAENITGRGIIANVDGQAVAV
GSAELLDHEPDSTRILELNAEGKTAMFVGVNGHAIGIVAVADAVRSDSASAIESLHKAGI
QVVMATGDAHRVAQNVASKLGVDEVYSELLPEQKLELVRDLQAAGKTVAMVGDGVNDTPA
LAAADIGVAMGVAGSPAAIETADIALMADRLPRLAHAVTLAKRTVRTMRINILIALATVM
VLLAGVLFGGVTMSVGMLVHEASVLLVISIAMLLLRPTLKEDAAQASDIKRSEIQQIA >RXN01000 TRANSLATE of: rxn01000.seq check: 4854 from: 1 to: 846
MSTLTSHRTVPAPSSPPARPNKLARNIVAIVAALIVLIATGTLKIEWNELPQMPAQVWHY
LELMFSDPDWSKFGRAVQEMWRSIAMAWLGAILCVVVSVPLGMLAARGVGPYWLRTVLRF
VFAVIRAFPEVVIAIILLTVTGLTPFTGALALGISGIGQQAKWTYEAIESTPTGPSEAVR
AAGGTTPEVLRWALWPQVAPSIASFALYRFEINIRTSAVLGIVGAGGIGSMLANYTNYRQ
WDTVGMLLIVVVVATMIVDLISGTIRRRIMKGASDRVVAPSN >RXN01002 TRANSLATE of: rxn01002.seq check: 1757 from: 1 to: 804
MNSDASATTNSWAINFDHVSVTYPNGTKALDDVSLTINPGEMVAIVGLSGSGKSTLIRTI
NGLVRATEGTVTVGPHQINTLKGKALRDARGQIGMIFQGFNLSERSSVFQNVLVGRFAHT
AWWRNLLGFPTEHDKQIAFHALESVGILHKVWTRAGALSGGQKQRVAIARALSQDPSVML
ADEPVASLDPPTAHSVMRDLENINNVEGLTVLVNLHLIDLARQYTTRLVGLRAGKLVYDG
PISEATDKDFEAIYGRPIQAKDLLGDRA >RXN01007 TRANSLATE of: rxn01007.seq check: 4278 from: 1 to: 1707
VFKKHRHGLGSPETKPRSITRRFFTAAAATLAGLAVLSGCTAQPSQAEDNTLTYLEPQFF
RTLYPPSAGFYPNGSVVNNIADRLLYQDPETLELKPWIATELPEVNEDATEFTFNIRTDV
TYSDGTPLTAENVVKNFDLYGLGDQDRRLTISEQITNYDHGEVVDEDTVRFHFSEPAPGF
AQATSSFNAGLYADSTLEFANEDFAPGNAQNVIGSGPFVITDETLGTNLTLTAREDYDWA
PPSREHQGRAKLDAVNYVLAGEESVRIGAIVAGQGDIARQIEAPVEAHLKDAGIPIISAA
TNGVNNSFNFRFKNELLSDIRVRQALIHAIDREKIMRVLFSDSYPLATSVLAQNALGYKE
QVDAYVYDLDKATALLDEAGWTLDSDGMRRKDGELLELTFNEALPQPRSREVVTMVQEQL
GDLGIKVNLNPGDQAAQDADSKDLNKIQVRHTMVGRADYDVLKSQLYSTNRNELLNMTVE
GETADIGDPHLEELLMAIASSPREEDRAAASAAAQDYITEQAYVLPLFEEPVVYGVQPYV
KGFSPEVIGRPSFYETYIDHSSDHSSEED >RXN01090 TRANSLATE of: rxn01090.seq check: 2624 from: 1 to: 798
MALPLPSKSARALVTGASQGIGLAIAKDLARYGHNLILVARREDVLKEIAADLEKKHGVI
VEVRPVDLSDEPARKVLIDEIKTREINIIINSAGIASFGPFKDQDWSYETAQFSLNATAV
FELTHAVLGGMIDRGTGAICNVGSAAGNVPIPNNATYVLTKAGVNAFTEAMHYELRGTGV
ACTLLAPGPVREAEIPESEKSIVDKVVPDFLWTTYESCSAETLRALSKNQRRVVPGPLSK
AMNFVSSVAPTAVLSPVMGWVYKKMG >RXN01114 TRANSLATE of: rxn01114.seq check: 9460 from: 1 to: 1224
MNPQDIVICSPLRTPVGAYGGSFTGVPVEELATTVINAIVEATGITGDDVDDLILGQASP
NGAAPALGRVVALDSKLGQNVPGMQLDRRCGSGLQAIVTAAAHVASGAADLIIAGGAESM
SRVEYTVSGDIRWGVKGGDMQLRDRLAEARETAGGRNHPIPGGMIETAENLRREYGISRE
EQDKISAASQQRWGKAADAGLFDDEIVPVTVPAKKRGQEPTIVSRDEHGRPGTTVEKLAA
```

Appendix B, page 31

Attorney Det No.: BGI-125CP

```
LRPIMGRQDAEATVTAGNASGQNDGAAAVIVTTRAKAEEKGLRPVMRLAGWSVAAVPPET
MGIGPVPATKKVLDRLGLTLEDIGAIELNEAFAAQALSVLKEWNISWEDERVNPLGSGIS
MGHPVGATGARMAVTLAHRMQRENTQYGLATMCIGGGQGLAAVFEKEN

>RXN01139 TRANSLATE of: rxn01139.seq check: 1443 from: 1 to: 954
MESHDLQQRSYAHNPDGHDHSHDGLGHSHAPSSLKALFAVIIFTSIIFLAELIAGLISGS
LALLADAMHMLSDSTGLIIAAVAMLIGRRARTSRATYGYKRAEVLAAMVNATVVTALSVW
IVVEAIMRLGKDLEIQTNLMLIVAVIGFVTNGISALVLMRHQDGNINMRGAFLHVLSDML
GSVAVIIAGLVIRYTGWMPADTIASIAIAAIIIPRAFSLLKEALNILLERVPTGAEPAEV
DAALRKVPGVSDVHDLHIWSIDGKEILATVHLVVDSSTNQLHSCGVLDRAEAELSKLGIL
HSTIQLESADHSDHESVC >RXN01141 TRANSLATE of: rxn01141.seq check: 9956 from: 1 to: 825
LSTALAGAARYVTSTSNNEPADNTPLTIGYVPIAGSAPIAIADALGLFKKHGVNVTLKKY
SGWSDLWTAYATEQLDVAHMLSPMTVAINAGVTNASRPTELSFTQNTNGQAITLASKHYG
SVNSAADLKGMVLGIPFEYSVHALLLRDYLVSNAVDPIADLELRLLRPADMVAQLTVEGI
DGFIGPGPFNERAISNGSGRIWLLTKQLWDKHPCCAVAMAKEWKAEHPTAAQGVLNALEE
ASAILSNPAQFDSSARTLSQEKYLNQPATLLDGPS >RXN01142 TRANSLATE of: rxn01142.seq check: 3960 from: 1 to: 498
LTARGNIDFGLRSARPSLSKTERADITRTHLEQVGLTDAAERRPARLSGGMQQRVGIARA
FAIDPPIMLLDEPFGALDALTRRELQLQLLNIWEASRRTVVMVTHDVDEAILLSDRVLVM
SKSPEATIITDIPVNLPRPRHELSEDASVEAETTALRKRMLHLLEH >RXN01164 TRANSLATE of: rxn01164.seq check: 868 from: 1 to: 1635
VTLFVRLALAAVGGLFVFASNEPIGWFVAGIVGTALFFISLAPWDLGVPQKRRKKNEPVP
FLQQMSTGPTVVQGMLLGFVHGLVTYLQLLPWIGEFVGSLPYVALSVVEALYSIALGAFG
VLIARWRDWKVLLFPAMYVAVEYLRSSWPFDGFAWVRLAWGQINGPLANLAALGGVAFVT
FSTVLAAVGVAMVIISKKRLAGAIITASVIAIGAVSSLYVDRNGTSDESIEVAAIQGNVP
RMGLDFNAQRRAVLANHARETLKLDEQVDLVIWPENSSDVNPFSDAQARAIIDGAVEHVQ
APILVGTITVDEVGPRNTMQVFDPVEGAAEYHNKKFLQPFGEYMPFREFLRIFSPYVDSA
GNFQPGDGTGVVEMNAANLGRAVTVGVMTCYEVIFDRAGRDAIANGAEFLTTPTNNATFG
FTDMTYQQLAMSRMRAIEFDRAVVVAATSGVSAIVNPDGSISQNTRIFEAATLTESIPLK
DTVTIAARVGFYVELLLVIIGVLAGLFAIRMNSRSKSAKGSARPAQVRVKKVPAKKAATN
RRKVK >RXN01168 TRANSLATE of: rxn01168.seq check: 6703 from: 1 to: 810
MSSEAVDATTLVIIPTYNELENLPLIVDRVRTATPDVHVLIVDDNSPDGTGERADKLAAD
DDHIFVLHREGKGGLCAEYMAGFQWGLERDYQVLCEMDADGSHAPEQLHLLLAEITNGAD
LVIGSRYVPGGRVVNWPKNRWLLSKGGNVYISVALGAGLTDMTAGYRAFRREVLEALPLD
ELSNAGYIFQVEIAYRAVEAGFDVREVPITFTEREIGESKLDGSFVKDSLLEVTKWGLKH
RGGQAKELSKEMVGLLNYEWKHFKKRNTWL >RXN01191 TRANSLATE of: rxn01191.seq check: 2562 from: 1 to: 1590
VGGLVDKLLATPSMRDVVVFALLIVAGGVVSSLGTWWGSALMARALEPAIAGLREDVLRA
AVSLDANTIETAGRGDVISRIADDSREVSTAASTVVPLMVQAGFTVVISAFGMAAVDWRL
GLVGLVAIPLYWTTLRVYLPRSGPLYTREREAFGVRTQRLVGAVEGAETLRAFRAEDTEL
KRIDAASGEARDISISVFRFLTWAFSRNNRAECITLVLILGTGFYLVNIDLVTVGAVSTA
ALIFHRLFGPIGTLVGMFSDIQSASASLIRMVGVINAASNQVSGTSPASASTALTLFDVS
HHYHTAPVIKNASVQLEPGEHIAIVGATGAGKSTLALIAAGLLSPTSGQVALGGSSFSNV
EPEALRQKIAMVSQEIHCFRGSVLDNLRIARPEATDADIHAVLADIGDSWLERLPQGIDT
IVGDGAFRLTSVENQIMALARVHLADLAIVILDEATAESGSDHAKQLEDAALKVTENRSA
IIVAHRLNQAKTADRIIVMDSGEIIESGTHEELRAIGGRYEQLWTAWSAR >RXN01212 TRANSLATE of: rxn01212.seq check: 3583 from: 1 to: 924
MPMTTTPAIDVTDLVRTYGDYTAVKGLNFHVQRGEVFGLLGTNGAGKTSTLEVIEGLSAP
SSGTVRISGLDPVADRAILRPELGIMLQSGGLPSQLTVAETMDMWHGTCTYPRAIKDVLA
DVDLLHRENVKVGALSGGEQRRLDLACALLGDPSILFLDEPTTGLDPESRRHTWQLLLDL
KQRGVTMMLTTHYLEEAEFLCDRIAIMNAGEIAVEGTLDELVAREKSIISFVLRGGQVEL
PVLSGAEIIRDNNHVRIATTTLQQHTLEILTWAAETGIALEGFAAKPATLESVFMDIASL
ENTSLQTA
```

Appendix B, page 32

Attorney Docket No.: BGI-125CP

```
>RXN01285 TRANSLATE of: rxn01285.seq check: 1049 from: 1 to: 726
LNVTIPDNTFTAIIGPNGCGKSTLLRGFSRVLNPQHGKVLLDGRQLDSFKPKEIARELGL
LPQTSIAPEGIRVYDLIARGRAPYQSLIQQWRTSDEDAVAQALASTNLTELAARLVDELS
GGQRQRVWVAMLLAQQTPIMLLDEPTTFLDIAHQYELLELLRAFNEAGKTVVTVLHDLNQ
AARYADHLIVMKDGHVHATGTPEEVLTAEMVQGVFGLPCIISPDPVTGTPTVVPLSRSRA
GA >RXN01298 TRANSLATE of: rxn01298.seq check: 8940 from: 1 to: 930
VSTLISEPEVDKLRKRAKRSRRTEWWLAAALLAPNLLLLAIFTYRPLLDNFRLSFFNWNI
SSPTSTFIGFDNYVEFFTRSDTLQVVLNTVIFTACAVIGSMVLGLLLAMLLDQKLFGRNF
VRSMVFAPFVISGAAIGVAFQFVFDPNFGLVQDLLGRIGVDSPQFYQNPNWALFMVTFTF
VWKNLGYSFVIYLAALQGLNKDLSEAAPVDGASAWTRFWKVTLPQLRPTTFFLSITVTLN
SVQVFDIIHTMTRGGPLGNGTTTLVYQVYTETFTNYRAGYGATIATILFLLLIITVIQV
RYMDKENKQK >RXN01338 TRANSLATE of: rxn01338.seq check: 9102 from: 1 to: 1902
KTYTPNPWMLFIRSFDGIITVAALVAIAIHLILWLALDLDGLAKNWPLIAIVIVGGIPLM
WDVLKSAIKTRGGADTLAAVSIITSVLLGEWLVAAIIVLMLSGGEALEEAASRRASGTLD
ALARRAPSTAHRLLGATILDGTEEIAVEEITVGDLVAVLPHELCPVDGEIVAGHGTMDES
YLTGEPYVVSKSKGSQAMSGAVNGDTPLTIVATKLAHDSRYAQIVGVLHEAENNRPEMRR
MADRLGAWYTVIALALGGLGWIVSGDPVRFLAVVVVATPCPLLIAVPVAIIGAISLAARR
GIIVKNPGMLENASGVKTVMFDKTGTLTYGRPVITDIHTAPGVEEDTVLALAASVERYSR
HPLADAIREGAKARELHLPDVVEVSERPGQGLTGTVGEHLVRITNRRSTLEIDPDSKNYI
PVTSSGMESVVLVDDKYAALIRLRDEPRASASEFIAHLPKKHKVDKLMIISGDRASEVRY
LADKVGIDEVHAEASPEDKLNIVNRHNEHGATMFLGDGINDAPAMAVATVGVAMGADSDV
TSEAADAVILDSSLERLDDLLHISARMRRIALQSAGGGMALSVIGMILAVFGFLTPLMGA
IFQEVIDVLAILNSARVALPRGAISDFDTQEKVS >RXN01382 TRANSLATE of: rxn01382.seq check: 7830 from: 1 to: 1092
MCTNNTGTSGSTSTAAGTGTANEEGTITAAISYELGTNGYDPMTTTSALTVAANWHTLEG
LTEIDPATGEVYAALASALPSADATSLDIKLRDGATFHNGDAVTADDVVFSFERVLDPAN
NSLYASFIPFIKSVTKKDDTTVTIDLDYATGIISERLAVVKIVPKSVVEADASGFDANPI
GSGPYKMTDNGASKVVKFERNDDYNGPRPARAAKMEWQIIPDASTRTNSLQSGSTMAIDS
VPYLSIPQLEATSTVESVQGFGLLFAMFSCSEGNPFNDVRNRQAFLYALDMDKIVKTGMS
DQATPATSFVQKEHPNYNQASTVYSLDADKAKALFAETGLTSLNLLCTDHDWVKNCTPLI
QESL >RXN01411 TRANSLATE of: rxn01411.seq check: 3735 from: 1 to: 765
MLGVGWRIPFLMAVPLGLIGWWIRTGAQENVRPASERPEAPIKQALRTEWKMMLRVGGFI
SCTGLSFYIFTTYMTTFLRSTVGLEGTLVLAGNIIALSMAAIVAPFVGRAIDKFPRRNIM
AFATLSTVIMAIPAYIIAGQGTLTASLIAQVMLGIGAVTANCVTSVMMAEVFQEVTRGTS
AGITYNVTYAIFGGSAPFISTALVSWTGSPLAPAVYMIIIALFAFTASRFIPETSPVFVT
ATPAIKAPKVLVNPG >RXN01421 TRANSLATE of: rxn01421.seq check: 1863 from: 1 to: 387
MTSKSISGKRPNLPSLTGARWLAALAVYFLHALVFLSVYPFQQSELFATIHKFVPMQLGS
AGVTFFFILSGFLIYWSNSQLKGMKNVLYYCKRRITKIYPMHLIALPMFIEASAKFTTTG
ITWVLILRE >RXN01602 TRANSLATE of: rxn01602.seq check: 2220 from: 1 to: 1530
MAKTHIRLQDLSLSYTSTPLITKLNITVSSGQCAVIVGENGRGKTTLLRALAREFPPSAG
EILTHGTVAIAHQHMPAGDLSVGEICDEAIRDSKNALEELERAGALLETNTAHALDGYQQ
ALDAAEVLDAWNAEHRLEKALRSFGAITDRSRALSELSIGQRYRVRLACLIGGDADILLL
DEPTNHLDRGALNYLTEAITSHKGVVLVVSHDQALIKDVADFIIDIDSTPDGLPRIYHEG
FDSYRRQRSALLETWRQDYAAAQTVQQQLQEDLEHARQRVNSSWKPPKGTGKHTRASRAP
GVVQALKRAQDALDSKALDVPPAPAPLLLPTLKVRPDKPMVDFSDLFVPHRLRLPGSHSV
VSGDKIVITGDNGAGKSTLIEVLSGVLTPASGSVANHARTGVLGQESLVGEVPSIARDHA
VKWGLLSVEESRFALQEFSIGQRRRLDLAMSLAGNPELLLLDEPSNHLSMHLVSALTEWL
DTTAAAVIMVTHDRQLLRDTAHWRHIELKS
```

Appendix B, page 33

Attorney Docket No.: BGI-125CP

```
>RXN01604 TRANSLATE of: rxn01604.seq check: 7962 from: 1 to: 648
MNTPLLRSSGLSIRDTPFADVEIAPDSGLTLLSTGRESQSSSFSLVLSGRMRASTGTIEL
NGEPIKATKLAKHVALAGIPEIDSLERLVTVRTVVREQLAWSSPWYLMVPRDISDSGRWV
DVEKHLGLNLNPKTLIGDLSVLERFKLRIALALLARPEAQLLVVDDPDQVRSMELRAEVL
HALKGVAEDLPVVVVSTNPDFDSLADTALTITGAGN >RXN01722 TRANSLATE of: rxn01722.seq check: 9580 from: 1 to: 1725
MLSTMQDVPLSLTRILEYGSTVHGDTLITTWGGADGIEQAQQTFSAVGARAAALAHALHD
SLGITGDQRVASMLYNCAEHMETMFAVACMGAVFNPLNKQLMNDQIVFILNHSEAEVVIA
DPRMAEQLGEILKETPKVRAVVFIGPNDFSSAAAHMPEGMKLYSYEALLDGRSTVYNWPE
QDERTAAAICYSTGTSGPPKGVVYSHRSLYLQSLSLRTTDSLAVEHGETFLCCVPIYHVL
SWGVPIAAFMSGTPLVLPGPDLSAPTLAKIISTTLPRVAHGVPTLWIQLMVHYLKNPPER
MSLRELYVGGSAVPPIVITMWEQRYGVDVVHVWGMTETSTVGTVSRPPSGVSGESRWNYR
VSQGRFPASLQYRIVNDGQVMASTDRNEGEIQVRGPWVTASYFHPDVEKEGGTASTFRDH
DVEEENDELFTADGWLRTGDVGSVTSDGFLTIQDRARDVIRSGGEWIYSAQLENLIVATE
EVVECAVIGFPDDKWVERPLAVTMLYPGIERTRETAERLRDQLRDRLPNWMLPEYWTFVD
EVDKTSVGKYDKKDLRNHLRNGDFEVIKLKGPGEK >RXN01732 TRANSLATE of: rxn01732.seq check: 6268 from: 1 to: 1050
MFKLSKPSKSMRVAVSTLAISTLALVGCSSSDESSSSSASSSSDAASQWPESITLSLVP
STEGEDLAEALAPLTDYLSENLGIEVNGVVASDYAATVEALGADQAQVIITDAGSLYNAI
EQYDAQLILRDVRFGATSYSAVAYTNNPDKYCDDAPVAASYAASDVDMLYCNGIETEGQA
ATGEGPAALDALEKIESGDKVALQAATSPAGYQYPIVAMQDLGMDTDSAFVQVPVEGNNN
AVLSVLNGDAEVSFGFWDARSTVLSEAPNAAEDVVAFAYTEMIPNGGVAASKSLPSDLVE
KLTELMDDYADSSEEAKDVMFDMVGLSDWTADTAQDEITRYGEILKKFSN >RXN01762 TRANSLATE of: rxn01762.seq check: 8097 from: 1 to: 1536
MKVNLGIGSYPRRRATVRPESTAIEFEGTSITYGEFSKRVNRLGHALLDLGVAHQDRVAY
VGFNHPALLEVFFSTNLIGATPVLVNPRLSANEIDYIIQDSGASIVFYGIDLIEHATYLQ
ELHPEIIMVAVEGDEGPGLRRKALIEAASDADIDLEVSDDDLVLLMYTSGTTGRPKGAML
SHRNLFFNYFNALLSQEIEQGAVLLSTAPLFHIAGLNMTTIPVMMKGGKVIIHREFRAEH
VLDEIERSKVSESFMVPAMIDMLSNHPSFAERDLSSLRAIMVGGSPLSERALRIWQGRDV
KIVQGFGMTETAPGACILEATDTSTHLGTAGRAHFFTDIKLVDPKTGEEVPTGEAGEVLI
RGPHVMTGYWNRPEDTASALQNGWYHSGDIAIKDEDGYYTIKDRIKDMYISGGENIYPAE
VEQALQELEAVLDAAVIGVPDERWGETGIAFVSIRESYLTNPPTGPELRELLGSVLARYK
LPREIHIIEELPRNATGKIQKNILRDFTIPVS >RXN01881 TRANSLATE of: rxn01881.seq check: 7932 from: 1 to: 435
MANLINLENVSKTWGLKTLLDGVSLGVQTGDRIGVVGLNGGGKTTLLEVLTGIEKPDQGR
VSHNSDLRMAVVTQRAELNDDDTVADVVLGPLGLEVFEWASNATVRDVLGGLGIVDLGLD
TKVGKPFPVGEAPTHQPGRRAGSRP >RXN01936 TRANSLATE of: rxn01936.seq check: 5923 from: 1 to: 1272
VSFRDIFADTRPLKEPAFKRLWLGNVATVIGAQLTVVAVPVQIYQMTGSSGYVGLTGLFG
LIPLVIFGLYGGSIADAFDKRIVLICTTIGMCVTTAGFWVLTILGNENIWLLLINFSLQQ
AFFAVNQPTRTAILRSILPIDQLASATSLNMLLMQTGAIVGPLIAGALIPLIGFGWLYFL
DVVSIIPTLWAVWSLPSIKPSGKVMKAGFASVVDGLKYLAGQPVLLMVMVLDLIAMIFGM
PRALYPEIAEVNFGGGDAGATMLAFMYSSMAVGAVLGGVLSGWVARISRQGVAVYWCIIA
WGAAVALGGVAIVVSPGAVTAWAWMFIIMMVIGGMADMFSSAVRNAILQQSAAEHVQGRI
QGVWIIVVVGGPRLADVLHGWAAEPLGAGWTVLWGGVAVVVLTAICMVAVPKFWKYEKPK
ITGI >RXN01946 TRANSLATE of: rxn01946.seq check: 7246 from: 1 to: 1275
IRKYSRLEEQFQSLGGYEADAEAAQICDNLGLEARILDQQLKTLSGGQRRRVELAQILFA
ATNGSGKSKTTLLLDEPTNHLDADSITWLRDFLAKHEGGLIMISHDVELLGAVCNKIWYL
DAVRSEADVYNMGFSKYVDARALDEARRRERANAEKKAGALKDQAARLGAKATKAAAAK
QMIARAERMIDNLDEIRVADRAANIVFPEPAPCGKTPLNAKGLTKMYGSLEVFAGVDLAI
DKGSRVVVLGFNGAGKTTLLKLLAGVERTDGEGGIVTGYGLKIGYFAQEHDTIDPDKSVW
QNTIEACADADQQSLRSLLGSFMFSGEQLDQPAGTLSGGEKTRLALATLVSSRANVLLLD
EPTNNLDPISREQVLDALRTYTGAVVLVTHDPGAVKALEPERVIVLPDGTEDLWNDQYME
IVELA
```

Appendix B, page 34

Attorney Docket No.: BGI-125CP

>RXN01995 TRANSLATE of: rxn01995.seq check: 3763 from: 1 to: 1338
MDIRQTINDTAMSRYQWFIVFIAVLLNALDGFDVLAMSFTANAVTEEFGLSGSQLGVLLS
SALFGMTAGSLLFGPIGDRFGRKNALMIALLFNVVGLVLSATAQSAGQLGVWRLITGIGI
GGILACITVVISEFSNNKNRGMAMSIYAAGYGIGASLGGFGAAQLIPTFGWRSVFAAGAI
ATGIATIATFFFLPESVDWLSTRRPAGARDKINYIARRLGKVGTFELPGEQSLSTKKAGL
QSYAVLVNKENRGTSIKLWVAFGIVMFGFYFANTWTPKLLVETGMSEQQGIIGGLMLSMG
GAFGSLLYGFLTTKFSSRNTLMTFMVLSGLTLILFISSTSVPSIAFASGVVVGMLINGCV
AGLYTLSPQLYSAEVRTTGVGAAIGMGRVGAISAPLLVGGLLDSGWSPTQLYVGVAVIVI
AGATALIGMRTQAVAVEKQPEALATK >RXN02062 TRANSLATE of: rxn02062.seq check: 5414 from: 1 to: 1170
MRVGMMTREYPPEVYGGAGVHVTELTRFMREIAEVDVHCMGAPRDMEGVFVHGVDPALES
ANPAIKTLSTGLRMAEAANNVDVVHSHTWYAGLGGHLAARLHGIPHVATAHSLEPDRPWK
REQLGGGYDVSSWSEKNAMEYADAVIAVSARMKDSILAAYPRIEPDNVRVVLNGIDTELW
QPRPTFDDAEDSVLRSLGVDPQRPIVAFVGRITRQKGVEHLIKAAALFDESVQLVLCAGA
PDTPEIAARTTALVEELQAKREGIFWVQDMLGKDKIQEILTAADTFVCPSIYEPLGIVNL
EAMACNTAVVASDVGGIPEVVVDGTTGALVHYDENDVETFERDIAEAVNKMVADRETAAK
FGLAGRERAINDFSWATIAQQTIDVYKSLM >RXN02074 TRANSLATE of: rxn02074.seq check: 7807 from: 1 to: 1623
MRSLLRDIPAVGWLITATIVVRTLVVALVIVGIGLLIDVPSPAHSAMLWWVLAGATAAAA
LLCAEAVLPQRIRARVERSWRRQLAAKNLELNSSSSDDAQLITLATEATSKASTYTVMFL
GPYFAVFLAPLTVIAVVGAAISWPIAGILCLGLCVIPFVISWAQRMLKGAGAGYGRASGQ
LAGVFLESVRTLGTTMMLNAAGQRRQIITQRAENMRSQVMSLLYRNQLMILVTDGVFGVA
TTMVAAVFAIGGFFSGSLTLGQAVALVLLARLLIDPINRMGRTFYTGMAGKPSLIAIEKA
LATTFTDQPTQQGQRHDGDLVVNNLKIARDHRDIVHGISFSIPRGSHIAVVGPSGAGKSS
VALALSGLLEFDGAISLGGHNCEMLDLRASVSFVPQSPTLFSGSIKSNIDLARTGVDSDH
IHAALLGEELPADLKVGETGKGVSGGQAARISIARGLVKNAAVIVLDEATAQLDYTNARQ
VRHLAKSLECTLVEITHRPSEALDADFIIVLEDGQLTMMDTPSNVSQHNAFFRTAVMEEE
Q >RXN02096 TRANSLATE of: rxn02096.seq check: 3261 from: 1 to: 1692
MGLDVSDEQIEHAARLAQAHDFIDRLPNKYEEVIGERGLTLSGGQRQRIALARAFLAHPK
VLVLDDATSAIDASTEDRIFQALREELHDVTILIIAHRHSTLELGDRVGLVEDGRVTALG
PLSEMRDHARFSHLMALDFQDSHDPEFTLDNGSLPSQEQLWPEVSTEKQYKILAPAPGRG
RGMSMPATPELLAQIEALPAATEETRVDAGRLRTSTSGFKLLSLFKQVRWLVVAVIALLL
VGVAADLAFPTLMRAAIDNGVQAQSTSTLWWIAIAGSVVVLLSWAAAAINTIITARTGER
LLYGLRLRSFVHLLRLSMSYFERTMSGRIMTRMTTDIDNLSSFLQSGLAQTVVSVGTLIG
VVTMLAITDAQLALVALSVVPIIIVLTLIFRRISSRLYTASREQASQVNAVFHESIAGLR
TAQMHRMEDQVFDNYAGEAEEFRRLRVKSQTAIAIYFPGLGALSEIAQALVLGFGALQVT
RGDISTGVLVAFVLYMGLMFGPIQQLSQIFDSYQQAAVGFRRITELLATQPSVQIWAPTG
TLGRLPRSLYCLTTSPSAIQTIRS >RXN02148 TRANSLATE of: rxn02148.seq check: 4200 from: 1 to: 1143
VSASRKTLVVTNDFPPRIGGIQSYLRDFIATQDPESIVVFASTQNAEEAHAYDKTLDYEV
IRWPRSVMLPTPTTAHAMAEIIREREIDNVWFGAAAPLALMAGTAKQAGASKVIASTHGH
EVGWSMLPGSRQSLRKIGTEVDVLTYISQYTLRRFKSAFGSHPTFEHLPSGVDVKRFTPA
TPEDKSATRKKLGFTDTTPVIACNSRLVPRKGQDSLIKAMPQVIAARPDAQLLIVGSGRY
ESTLRRLATDVSQNVKFLGRLEYQDMINTLAAADIFAMPARTRGGGLDVEGLGIVYLEAQ
ACGVPVIAGTSGGAPETVTPATGLVVEGSDVDKLSELLIELLDDPIRRAAMGAAGRAHVE
AEWSWEIMGERLTNILQSEPR >RXN02168 TRANSLATE of: rxn02168.seq check: 2810 from: 1 to: 2814
VSISSLTPLHSFKEPAILYAGQASAWCQVIADSSEDHITATHLRELLSRSRAKTAPFARQ
ITAIVPGSLARLEELTREDAQIGADIDAQPAVSIPGILLGQIAATRQLRDLGLDVAAASR
LGHSQGILGVEAVDNEEDVLAFAILLGAAASQFAGKGAHMLSVRGLSREIIQDTIAGVDG
VEVSLRNARAHFVVSGKPEALKKAAAALQRAADVYNEDINEKRKGGSLAEPKFDYLDVAI
PFHHSSMQDAADLAVEWATTCGLNVNARALAEAILVNPADWVEQIANLKADYVLSLDAGV
SRFTAPLLDGRGISLVPAFSAAERDNLARPGFHVPTAEDWSEFAPKLVKLPNGEHKVLTG
FSRLTGYSPIVLAGMTPTTVDPEIVAAAANAGHWAEMAGGGQYSEEVFTKNKEKLVSLLK Appendix B, page 35

Attorney Docket No.: BGI-125CP

```
VGRSAQFNSMFFDRYMWNLQFGAQRIVSKARATGTSINGVVVSAGIPEVEEATELINDLN
ADGFPYVAFKPGTVDQIRATLKIADANPETKIIIQIEDGHAGGHHSWVNLDDLLLTTYAE
LRSRKNVVVMIGGGIGTPAKAAYYLTGEWSTDLGFPAMPVDGILVGTAAMATKEATTSPQ
VKQALVDTPGVDPHDAGGWVGRGDARGGVTSGLSHLHADMYELDNDSAAASRLISSIDSD
DYADHREELIEAINKTAKPFFGEVEEMTYAEWIQRWVELAYPTQDPTWDDRFLDLVHRIE
ARLNEAEHGAITTLFPDHASVENEEEAVEKLLAAYPQAREIQVSARDAAWFIGLCRKHHK
PMPWVPAIDADLARWWGLDTLWQSQNERYGANSVRVIPGPVSVAGIDRVDEPVAELLGRF
EAACVDALDGEPEEIFARLNESKNEREFLLATPHIVWHGNLIDNPAHVLNEGAFELIEED
GYWVIRILADSYFDDLPVEQRPYLVQHVDIPVELGDAG

>RXN02233 TRANSLATE of: rxn02233.seq check: 3705 from: 1 to: 1287
VLVTSTWGWTVHGDGKKIEPGAVVAPKERLSWGRTIGIGMQHVIAMFGATLLVPTLTGFP
VNTTLLFSGLGTILFLLITRNRLPSYLGSSFAFIAPLTATQVHGIGVQIGGILVAGLVLV
AIGFVVKAAGKRVIDAVMPPAVTGAIVALIGLNLAPTAAGNFSSQPLVATATLFAILIAT
VAGRGMIARLGILIGVVIGWVFAAITGNLSEGAADTIREAAWFGLPQFHKPEFQLSAILV
TLPVIIVLIAENVGHVKAVSEMTGEDLDDLAGDALIADGFGTTLAGAFGGSGTTTYAENI
GVMAATRVYSTAAYWVAACTAIALAFIPKFGALIFTIPAGVLGGACLVLYGLIGMLGIRI
WQDNKVNFNNPVNLTMAAVALVAGIGNLTLTVFGVTLEGIAWGSVGIIVLYPIMKRLYLS
IGEGKNAKF >RXN02309 TRANSLATE of: rxn02309.seq check: 2713 from: 1 to: 1050
MSSGRTVPTRSHGLGKEGVSTTGASQVEFGDPELTARINDAMVQVEELLHTELSSGEDFL
VDIVMHLTRAGGKRFRPMFALLASEFGEKPLSENVIKAAVVVEITHLATLYHDDVMDEAS
MRRGVPSANARWDNSVAILAGDILLAHASGLMSQLGTDTVAHFAETFGELVTGQMRETVG
PRDTDPIEHYTNVIREKTGVLIASAGYLGAMHAGAAPEHIDALKNFGAAVGMIFQIVDDI
IDIFSETHESGKTPGTDLREGVFTLPVLYALREDTPVGAELRDILTGPLEDDETVNHVLE
LLSQSGGRQAALDEVYRYMDIANAELDRLPDSTVKEALRNLATFTVKRVG >RXN02321 TRANSLATE of: rxn02321.seq check: 7699 from: 1 to: 1629
MTISSPLIDVANLPDINTTAGKIADLKARRAEAHFPMGEKAVEKVHAAGRLTARERLDYL
LDEGSFIETDQLARHRTTAFCLGAKRPATDGIVTGWGTIDGREVCIFSQDGTVFGGALGE
VYGEKMIKIMELAIDTGRPLIGLYEGAGARIQDGAVSLDFISQTFYQNIQASGVIPQISV
IMGACAGGNAYGPALTDFVVMVDKTSKMFVTGPDVIKTVTGEEITQEELGGATTHMVTAG
NSHYTAATDEEALDWVQDLVSFLPSNKRSYAPMEDFDEEEGGVEENITADDLKLDEIIPD
SATVPYDVRDVIECLTDDGEYLEIQADRAENVVIAFGRIEGQSVGFVANQPTQFAGCLDI
DSSEKAARFVRTCDAFNIPIVMLVDVFGFLPGAGQEYGGILRRGAKLLYAYGEATVPKIT
VTMRKAYGGAYCVMGSKGLGSDINLAWPTAQIAVMGAAGAVGFIYRKELMAADAKGLDTV
ALAKSFEREYEDHMLNPYHAAERGLIDAVILPSETRGQISRNLRLLKHKNVTRPARKHGN
MPL >RXN02342 TRANSLATE of: rxn02342.seq check: 2806 from: 1 to: 807
MNVDISRSREPLNVELLKEKLLQNGDFGQVIYEKVTGSTNADLLALAGSGAPNWTVKTVE
FQDHARGRLGRPWSAPEGSQTIVSVLVQLSIDQVDRIGTIPLAAGLAVMDALNDLGVEGA
GLKWPNDVQIHGKKLCGILVEATGFDSTPTVVIGWGTNISLTKEELPVPHATSLALEGVE
VDRTTFLINMLTHLHTRLDQWQGPSVDWLDDYRAVCSSIGQDVRVLLPGDKELLGEAIGV
ATGGEIRVRDASGTVHTLNAGEITHLRLQ >RXN02348 TRANSLATE of: rxn02348.seq check: 8038 from: 1 to: 1884
MLNRMKSARPKSVAPKSGQALLTLGALGVVFGDIGTSPLYSLHTAFSMQHNKVEVTQENV
YGIISMVLWTITLIVTVKYVMLVTRADNQGQGGILALVALLKNRGHWGKFVAVAGMLGAA
LFYGDVVITPAISVLSATEGLTVISPSFERFILPVSLAVLIAIFAIQPLGTEKVGKAFGP
IMLLWFVTLAGLGIPQIIGHPEILQSLSPHWALRLIVAEPFQAFVLLGAVVLTVTGAEAL
YADMGHFGARPIRVAWFCVVMPALILTYLGQGALVINQPEAVRNPMFYLAPEGLRIPLVI
LATIATVIASQAVISGAYSLTKQAVNLKLLPRMVIRHTSRKEEGQIYMPLVNGLLFVSVM
VVVLVFRSSESLASAYGLAVTGTLVLVSVLYLIYVHTTWWKTALFIVLIGIPEVLLFASN
TTKIHDGGWLPLLIAAVLIVVMRTWEWGSDRVNQERAELELPMDKFLEKLDQPHNIGLRK
VAEVAVFPHGTSDTVPLSLVRCVKDLKLLYREIVIVRIVQEHVPHVPPEERAEMEVLHHA
PIRVVRVDLHLGYFDEQNLPEHLHAIDPTWDNATYFLSALTLRSRLPGKIAGWRDRLYLS
MERNQASRTESFKLQPSKTITVGTELHL >RXN02372 TRANSLATE of: rxn02372.seq check: 3258 from: 1 to: 1887
```

Appendix B, page 36

Attorney Docket No.: BGI-125CP

```
VPPAPKLAALGLQHVLAFYAGAVIVPLLIAQSLNLDTATTIHLINADLLTCGIATLIQSV
GIGRHIGVRLPIVQGVTTTAVAPIIAIGLGVTDGQGGVASLPAIYGAVIVSGIFTFFAAP
VFARFLKFFPPVVTGTVLLVMGASLLSVSANDFVNYADGVPAARDLAYGFGTLAVIILAQ
RFFRGFMGTLAVLIGLVGGTAVALILGDANLDEVGNAEAFDITTPFYFGVPEFNAVAIFS
MIIVMIITMVETTGDVFATGEIVGKRTRRSDVTRALRADGLSTLMGGVMNSFPYTCFAQN
VGLVRITGVKSRWVAAAAAGFMIILGVLPKAGAIVASIPSPVLGGASLALFANVAWWVGIQ
TIAKSDLADSRNSVIVTSALGLAMLVSFRPDVAQAFPEWARIFVSSGMSVGAITAILLNL
LFFHVGRQSGGQVATSKSGERINLDAVNKMDRTDFVETFAPLFNSKTWPLETAWESQPFA
NVTELREAIQVAVLTAPLSDREELIHDYPDMAQLILATEEEAATISQDRGSIGLDDLDDV
DQEKLITVTEQYRERFNMPYVAYFDTMDSVDTVVAAGLRRLDNSDEQEHRQALSEIIEIA
NDRFDILLADANPARSAFDRKFTETDFLG

>RXN02395 TRANSLATE of: rxn02395.seq check: 9305 from: 1 to: 1890
MSTNSGNNLPESQESPEEPHYPHDTHPGLVPGISVDAQRNKFGLDKTVFGVTAALILAFI
AWGISSPDSVSSVSSTMFSWAMTNTGWLLNFVMLIGIGTMLYIAFSRYGRIKLGTDEDEP
EFSRFSWIAMMFGAGIGVGIFFFGPSEPLWHYLSPPPHTVEGSTPESLHQALAQSHFHWG
LSAWGLYALVGGALAYSSYRRGRVTLISSTFRSLFGEKTEGIAGRLIDMMAIIATLFGTA
ATLGLSAIQVGQGVQIISGASEITNNILIAIIAILTIGFIISSVSGVSKGIRYLSNLNIS
LTLGLVLFVFITGPTLFLLNLIPSSVLEYGSEFLSMAGKSLSWGEETIEFQAGWTAFYWA
WWIAWTPFVGMFIARISRGRTLREFALITMAIPSFILILAFTIFGGTAITMNRENVDGFD
GSSSKEQVLFDMFSNLPLYSITPFILIFVLAVFFVTSADSASVVMGTMSSQGNPAPNKLI
VVFWGLCMMGIAVVMLLTGGESALTGLQNLTILIAIPFALVLIVMAIAFIKDLSTDPAAI
RQRYAKAAISNAVVRGLEEHGDDFELSIEPAEEGRGAGATFDSTADHITDWYQRTDEEGN
DVDYDFTTGKWADGWTPESTEEGEVDAKKD >RXN02424 TRANSLATE of: rxn02424.seq check: 9493 from: 1 to: 600
MTNELTLHHISVSQMDNNCYLLAANGNGLLIDAADDAAALLKLAEDAGVTITKVLTTHRH
ADHVRALPEVLQKTGATHYAPFLEVPALPSAVDVELHHGDSIEFEGHVFPISILRGHTPG
GAVLTAEIDGKTHLFVGDSLFPGGLGKTSSEGDFVRLFNDVKERIFDTYDDDSIVWPGHG
KETTLGAERPQLEIWWERRW >RXN02442 TRANSLATE of: rxn02442.seq check: 5164 from: 1 to: 849
MKFFTDALIVPFDVSFISRALVAGCLAAILCSLIGTWVILRRLTFFGDAMSHGLLPGVAT
ASLLGGNLMFGAAISALIMSAGVVWTSRKSSLSQDVSIGLQFITMLSLGVVIVSHSDSHA
VDLTSFLFGDILGVRPSDIFIIAIATVLGGLTIFLFHRQFTALAFDERKAHTLGLNPRFA
HLLMLALIALATVVSFQVVGTLLVFGLLIGPPATAALLVQDKASISLIMIVASLLGCAEI
YLGLLISWHASTAAGATITLLSAAIFFATLLTKSAISRLNFTA >RXN02443 TRANSLATE of: rxn02443.seq check: 7945 from: 1 to: 954
VILKDIFNNGELFGASSAKNFRKLLAVPAVAASLAFGITACSAVDDTPDIVVTTNILGDV
VSHIVGDSADVQVLMKPNADPHSFGVSAQDAAAMEHADLIVANGLGLEEGLQSNVDNAKS
QGVPVLEVGEHIDVIDYSPGVPDPHFWTDPARMIAATEVIEAELIKELDPSLTESITQSA
QHYREELVALDEEVTELLSGVAPENRKLVTNHNVFGYLASRFNYTVIDTIIPGGSTLAAP
SASDLNDISTAIEDNNVPAIFTDTSSPQRLAEVLASNAGIDVQVVSIFTESLTDADGEAP
TYISMQKINAERIASTLS >RXN02447 TRANSLATE of: rxn02447.seq check: 8454 from: 1 to: 1095
TVVPVYLAELAPLEIRGSLTGRNELAIVTGQLLAFVINALIAVTLHGVIDGIWRIMFAVC
ALPAVALFLGMLRMPESPRWLVNQGRYDDARRVMETVRTPERAKAEMDEIIAVHSENNAA
LPGVKQSSGQASGQVSSKHTHMSIGEVLSNKWLVRLLIAGIGVAVAQQLTGINAIMYYGT
RVLEESGMSAEMAVVANIAFGAVAVIGGLIALRNMDRLDRRTTFIIGLSLTTTFHLLIAA
AGTLLPEGNSIRPFAIMILVVGFVLSMQTFLNVAVWVWLAEIFPVRMKGIGTGISVFCGW
GINGVLALFFPALVSGVGITFSFLIFAVVGVIALAFVTKFVPETRGRSLEELDHAAFTGQ
IFKKA >RXN02487 TRANSLATE of: rxn02487.seq check: 2200 from: 1 to: 1704
MSAYETKEWLQHYPEWTPHSLEYGDTTLLDVYDNNLAINADKPATYFFGRSQTYGELDKE
VRKTAAGLRALGVRPGDHVAIILPNCPQHIAAFYAVLKLGAVVIEHNPLYTAHELLEPFK
DHGARVAIVWDKASPTVEQLRGQTQLETIVSVNMINAMPPLQRLALRLPIPALRKSRESL
SGAAPNTVPFETLTSAAMGGDGDDVVSEPTVTKESVALILYTSGTTGRPKGAQLTHGNLF
```

Appendix B, page 37

Attorney Docket No.: BGI-125CP

FNLLQGKHWVPGLGDKPERMLAALPMFHAYGLTMVGTLSVFIGGEMVLLPTPRIDLIMNV
MKKHTPTWLPGVPTLYEKIVDASEKEGIPIKGVRNAFSGASTLSQRTVERWEKHTGGRLV
EGYGLTETSPIIVGNPMSDHRRQGYVGIPFPDTIVRIANPENLDETMPDGSEGEVLVKGP
QVFKGYLNQEEATKNSFHGEWYRTGDVGVMEEDGFIRLVARIKEVIITGGFNVYPAEVEE
VLAEHPDIEDSAVVGIPREDGSENVVAAITLVEGAALDPDGLKEFARKNLTRYKVPRTFY
HFEEMPRDQMGKIRRREVQAELLKKLGK

>RXN02512 TRANSLATE of: rxn02512.seq check: 4913 from: 1 to: 963
MKPKDFCTAENWAENLSALGYLAGWRFVRMLPLPIARRVFDLGADLASKSGKGMGQLRAN
LARVVGAENVTQALVKQATRSYARYWLEAFRLPAIARDPELLARLRKGTVGLDLLDESLA
AGKGVVLTLPHSGNWDMAGAFLISHHGQFTTVAERVKPERLFEAFVEFRESLGFEVLPLT
GGERPPFEKLKERLTSGGIVCLLGERDLRHSGVETTFFGEKTSMPAGPAQLAIETGAALH
VVHPWFDDDGWGLSVSDAVTVDNLSDTVQRIAHLFMANITAHPADWHMLQPLWFGDLDPE
RLKRSREQTNVHKPVALQEDN >RXN02515 TRANSLATE of: rxn02515.seq check: 4857 from: 1 to: 756
MSTLEIRNLHAQVLPSDESAEPKEILKGVNLTINSGEIHAIMGPNGSGKSTLAYTLGGHP
RYEVTAGEVLLDGENILEMEVDERARAGLFLAMQYPTEIPGVSVANFLRSAATAIRGEAP
KLREWVKEVRTAQEALAIDPEFSNRSVNEGFSGGEKKRHEVLQLDLLKPKFAIMDETDSG
LDVDALRIVSEGINSYKQETEGGILMITHYKRILNYVKPDFIHVFANGQIVTTGGAELAD
KLEADGYDQFIK >RXN02547 TRANSLATE of: rxn02547.seq check: 8918 from: 1 to: 2139
LELNNAARLTVDEYPAAREALESAGQRNVEDRTRAVDEFKAADQELSSLSKGSSNIEYRL
LQVRENLCQDLGVSPRDMPFAGELIDPNNAEWEPVVQRILGGFAAEMLVPHGLLPRVRDW
VNAKHLAALLKFNGVVTTGEYKTSRFPADSLIRKVDVVESPFRDWVNQELGKRFNIRCVR
TPEELSALGPRDQGVTILGVRKFAQQTGDPTTRWEKDDRRKLGDRSTYRLGSTNDAKVET
LRETVKAGKAVVQAADNRIAANRAELRELERQYQASQEILKVSWAQIDVESADAAIAELD
RLLEELNNTPEATELSARHEAAKQTLARVSDLLVAAQSEETVASMNLKRAETELKRLESL
PVAEVSEEIAREVEKLFLANTRRVHAANVDEQTIALREDLDKQIDANEAELRRCENQIVG
ILRSYIETWPANRADLQAEPEFVGEAINRLGELRSDRLAEFTAKFLGLMNEMSTRNLGQI
SRRLRDARREIEERIEPINASLAQSEFNEGRFLHIDIRDQSGPIVREFQQKLDAATSGDL
GTSTEKQAFARYALIAEIISKLASHDSADARWRNTVLDTRRHVRFIGLERDSDGATVNTY
VDSASLSGGQAQKLVFFCLAAALRYQLAEPGAHYPTYATVILDEAFDRADPAFTRQTMNV
FHSFGFHMVLATPLKLIQTLGDYVGSTIVVSYTEKPNAQGAIQGNSSFSRIEK >RXN02566 TRANSLATE of: rxn02566.seq check: 3653 from: 1 to: 1209
MHASSPQPHPQRTRVLSGLIFAQIMVGASNGVTLSMGSLLAAHLAGASWGGSAATLTTIG
AAIFSIPLARMVSTYDRRTSLSTGMLLGCVGALLAILGAQFGLFPVVLLAFLFLGSMSAV
NLQARFAATDVASEETRGRDLSIVVWSTTIGAIAGPNLFEPSARFSETLGLEQHAGAYLL
CLFGQLIAIAVWRFTLPKGLKPEATPNAPTEKKRLTPKALQAITSVATAHFSMVGLMSMA
AIHMQGHGASLTIIGFTISLHVAGMYALSPVFGLLTDKLGRNVTIYSGFAMLATSAAFLI
IWPEPQWAMITSMILLGLGWNSALVGSSTLLVDATPIHHRTYAQGRSDLTMNLAGASGGL
IAGPLIAMGGMPLLAGVVLAVVALQTVLSFRTRSIEKTPASCF >RXN02571 TRANSLATE of: rxn02571.seq check: 6786 from: 1 to: 1029
VVALTQIVGPSGSGLTRELEKRYRETPGAVMLTADPRAHITYLRATVAEELAFGLEQRGI
VPAQMWERVRNIGLGLENLLDRAPAQLSGGQTRRLAIGTVAILEAPTMLLDDPLSGLDTS
SRAQLITMLESYEGDVIVAAHKRWLDAPTVYLGDLEELSLPARVEFSGPSRTFSAITGTR
GQQRRRWWQFNESQPQFQIGPLDITVSAGQVLWLQGPNGSGKSTLLRGLANEPGTELMLQ
NPSDQVIDSTVANWVPGSNSEEHPLDLSQRELRLAQCDAALGNNPEVLLADEPDVGLDVG
GRNAIHQRFADFLGNGGALILTCHDETFVAEVAEYAIVKEMGL >RXN02581 TRANSLATE of: rxn02581.seq check: 7801 from: 1 to: 1860
MDLDKAIGSFFDENGEINLPPFLTLAAMGEFMYQADIAEGGGDKPRMHFWDFSEDRDGKL
IQYTRNEIDTRIKAVAGRLQQVATLGDRAAILANNSPEYIFSFLGAIYAGMVPVPLYDPN
EPGHADHLNAVFADSEPVVVLTNSKSAGAVRKHFSSLPAAERPRILSVDSLPDSLADSYE
NPMLTEAGRRLAALRQSAPIDLTAFLQYTSGSTRTPAGVVLTNRSILTNVLQIFSAAQLK
TPLRLVSWLPLHHDMGIILAAFVTMLGLDNEFMNPRDFVQQPSRWIKQLNRRESDVDVNV
YTVVPNFALELAARYAKPAEGETLDLSALDAIIGSEPVTENALTTFREAFEPYGLPVQT Appendix B, page 38

Attorney D___ et No.: BGI-125CP

LRPSYGLAEASLLVTTPQTENRPLISYFDREALAENRVELVEKGNNKAVAFVSNGQVAAP
QQLVIVDSETGTELADGQIGEIWTHGENTAAGYLDREEDTAETFRNRLTTRLEENSRAEG
AADDNYWMATGDLGVIVDNELYITGRLKDLIVVAGRNHYPQDIEYTVQAASAHIRADSVA
AFAVPGDDIEKLIILAERDTTANEADDAAAEEAIRSAVGTAHGVVPEEIRILAPDEIARS
SSGKIARRVNQRNYIQEQAN

>RXN02595 TRANSLATE of: rxn02595.seq check: 5016 from: 1 to: 1164
VIVVAMASIMACLKAARLNNPMKILLLCWRDTTHPQGGGSERYLERVGEFLADQGHEVVF
RTAGHTDAPRRSFRDGVRYSRSGGKFSVYPKAWVAMMLGRVGIGTFSKVDVVVDTQNGIP
FFGKFFSGKPTVLLTHHCHKEQWPVVGRVLAKVGWLIESQIAPRAYKTAPYVTVSEPSAE
ELIALGVDQQRIHIVRNGVDPVPLHTPKLDRDGQHAVTLSRLVPHKQIEHAMDVVAALDG
VVLDVVESGWWQKELVDYARTLGVSDRVVFHGQVAEDHKHALLERATIHLMPSRKEGWGL
AVTEAAQHGVPTIGYRSSGGLRDSVVDGETGLLVDSKAELISATKTLLIDASLRSKLGAS
AKQRAENYKWDTAGAQFEELLLGLASKK >RXN02613 TRANSLATE of: rxn02613.seq check: 5283 from: 1 to: 957
MKFKKIALVLAFGLGLASCSSASGDPATNADGSIDLSKVTLNIGDQIAGTEQVLQASGEL
DDVPYKIEWSSFTSGPPQIEALNAGQIDFAITGNTPPIIGGPTNTKVVSAYNNDALGDVI
LVAPDSSITSVADLAGKKVAVARGSSAHGHLIQQLEKAGVSVDDVEINLLQPSDAKAAFQ
NGQVDAWAVWDPYSSQAELEGAQVLVRGAGLVSGHGFGVASDEALDDPAKEAALADFLDR
VADSYEWAEDNTDEWATIFSQESGFDPEASQLNTRSLRHQVPLDESVNTYQNALIDAFVS
AGLVEDFNFEDTVDTRFEG >RXN02614 TRANSLATE of: rxn02614.seq check: 5216 from: 1 to: 729
MTATLSLKPAATVRGLRKSYGTKEVLQGIDLTINCGEVTALIGRSGSGKSTILRVLAGLS
KEHSGSVEISGNPAVAFQEPRLLPWKTVLDNVTFGLNRTDISWSEAQERASALLAEVKLP
DSDAAWPLTLSGGQAQRVSLARALISEPELLLLDEPFGALDALTRLTAQDLLLKTVNTRN
LGVLLVTHDVSEAIALADHVLLLDDGAITHSLTVDIPGDRRTHPSFASYTAQLLEWLEIT
TPA >RXN02638 TRANSLATE of: rxn02638.seq check: 9546 from: 1 to: 876
MVKRFGFFVEDSLPKVPLHPEESRETFYGRIIISAVRTVMKAQDVQISIFGAENIPTTGG
ALFASTTLVIMTSFWVVSPAFVRGKRLVRFMAKKEIFDTPVVGTLMRWMKHVSVDRSAGA
GSMEDARKRLDAGSLVGIFPEATVSRSFEIKELKTGAVRIADSANVPLLPLIIWGGQRII
TKDIERDFGRSHIPVFISVGEPVDASGDPDEATERLYEAMKKLLDETRTAYEQKYGPFEG
GELWRPKSLGGGAPTLEQAKMLEIAERERRQAKRAAKVAKKRTTFIRKIFKK >RXN02662 TRANSLATE of: rxn02662.seq check: 3 from: 1 to: 264
MRRKLTTTLENKPGARLGGFRALAPTSKIALVFLLLIFLLAIFAPLIAKYDPLASGTPVQ
PPSGEHWFGTDAIGRDIFSRVATAPEPP >RXN02794 TRANSLATE of: rxn02794.seq check: 5710 from: 1 to: 1074
MLLSARTHTSFQELGLNASRRKAINWTLALTVVLIASMFVGVLIGASGTSVFSTWTVISH
HLFGTELGGSDTADAIIWYIRTPRVLLAAIVGAGLALAGAIMQVLVRNMLADPYILGVNS
GASCGAAAALLFGVGAGFGDYALQGSAFLGAMAASGLIFFVARAAGRISSTRLLMSGVAI
GYMLSAATSFLIFSSDSAEGSRSVLFWLLGSLGLAAWNGPMAIIFLIVGIALALLMVLGP
QLDALNSGDETALTLGVSPDRLRILLLVITCLLVGSMVAMAGSIGFIGLVIPHLARRFVS
GKHRLMLPVSALMGAILLIWADIAARTLLAPQEIPIGIITALIGAPFLLILVRRMHTY >RXN02809 TRANSLATE of: rxn02809.seq check: 5264 from: 1 to: 375
NLSVPAALTNALSYLSAEWNNKAAGIVSYGSAMGVRAAEHLRGILSELQIAHVQKTGLLS
IFTDFEYPNFKPSEQGISSVDAMLEQLVVWTKAMSTIRESANVYHLRTPHKSGELPDWDS
PLFVF >RXN02836 TRANSLATE of: rxn02836.seq check: 9870 from: 1 to: 555
MTIDEGRRQFEVNVFGAMALTRLVLPHMQKQKWGTIVNITSMGGKIYTPLGGWYHGTKFA
LEALSDALRLEVAPFGIDVVVIEPGGIATEWGGIAADNLDAVSKDSAYKRQADAVSKSLR
SEANSNRNSPPSVVADAIGKAVTARHPKTRYAIGFGAKPLIASRNILTDRQFDPVITRAT
GVPRD >RXN02922 TRANSLATE of: rxn02922.seq check: 7833 from: 1 to: 1080

Appendix B, page 39

Attorney Docket No.: BGI-125CP

```
MISPQTIIDNLAPVLAEIAATAAQREQDREFSRDLAKQLSAGGFTKLRIPVEFGGLGFSL
PEAFEVLVAAAAADSNIAQGLRPHFLAVESLLIAPYSEHRTKWLRKIAEKGVVIGNALTE
VGNKPGELKTKIRKEGESYVLSDTKFYSTGSLYADWIQVHAKDEEDQDVFAFVDRDASGV
VLVDYWDEFGQQLFASGTSFFEKVVVDPLDIVTRDYTAPSAFQALAQSHHLSTLTGISQA
ITRDIVTYVQNRTIFSHGSGDLPRFDPQVQQVVGEVKAKSYAVEKIFQGFAQELDLVVD
KAKAGTATEVDLAAVDLSAYQAQLAVAPLVLSQATQAFEVGADALNGGHVAAQYTIGSLS

>RXN02923 TRANSLATE of: rxn02923.seq check: 3360 from: 1 to: 738
LSILLLGGTSDIAGEIATLTCHGEDVVAARRPEAAQGLAEDLRQRGATSVHVLSFDAQV
LDTHRELVKKTQELAGEISLAVVAFGILGDQERAETDETHAVEIATVDYTAQVSMLTVLA
DELRAQTTPAAIVAFSSIAGWRARRPNYVYGSTKAGLDAFCQGLADSLHGTHVRLIIARP
GFVIGSMTTGMKPAPMSVYPRDVAAAVVSAYTSKKRSTTLWIPGRLRVLAWIMRMVPRPV
WRKMPR >RXN02929 TRANSLATE of: rxn02929.seq check: 8015 from: 1 to: 1038
VLKRIFLNPWVATALSVVILGFVVLFSGFSGVIDLSPTAVIRHLSGQDTLTPRDQAIFFD
IRLPRIIAGVIVGATLAISGASYQAVFRNPLADPYLLGVSAGSGLGVTAVIVGGTVLGFS
APSIGVIGAAFVGGVAAVLATLMVSRGVGQGSSTTVVILAGVAVAAFASSIQTYIQQRHI
DTVARVYVWMLGNLNVTNWMSIFIVAVVAGLCAAVIMSCARLLDVMAVGDVEARTLGVDP
GLVRIGIVIVATLGTAAVVSISGLIGFVGIIVPHALRLIVGPGHRILLPLSFVWGAIFLV
LADTAGRTLMAPQELPVGVVTAALGAPFFLFILRRTSRQRVPKRSA >RXN02933 TRANSLATE of: rxn02933.seq check: 4913 from: 1 to: 810
MPLSGKIGGFIVAVVFVLAALSFIWTPFDPVQAFPQERLEGSSLRHLLGTDRYGRDVLSQ
IMVGSRVTLLVGIIAVAIAALIGTPLGIAAGMRRGMVETFVMRGADLMLAFPALLLAIIS
GAVFGASTWSAMVAIGIAGIPSFARVARAGTLQVTSQDFIAAARLSKVSSARIALRHILP
NITSMLIVQASVAFALAILAEEAALSFLGLGTTPPDPSWGRMLQTAQASIGVTPMLAVWPG
AAIALTVLGFNLFGDGLRDAIDPKREVGRA >RXN02947 TRANSLATE of: rxn02947.seq check: 6735 from: 1 to: 1314
MTAAQTKPDLTTTAGKLSDLRSRLAEAQAPMGEATVEKVHAAGRKTARERIEYLLDEGSF
VEIDALARHRSKNFGLDAKRPVTDGVVTGYGTIDGRKVCVFSQDGAVFGGALGEVYGEKI
VKVMDLAIKTGVPLIGINEGAGARIQEGVVSLGLYSQIFYRNTQASGVIPQISLIMGACA
GGHVYSPALTDFIVMVDQTSKMFITGPDVIKTVTGEDVTQEELGGAHTHMATSGTSHYSA
SDDSDALDWVRELTSYLPSNNRAETPRQEADIMIGSIQENINDVDLELDTIIPDSPNQPY
DMKEVISRIVDDAEFFEIQEDYAENILCGFARVEVRSVGIVANQPTQFAGCLDIKASEKA
ARFIRTCDAFNIPILEFVDVPGFLPGTNQEFDGIIRRGAKLLYAYAEATVGKITVITRKS
YGGAYCVMGSKDMGAGLV >RXN02955 TRANSLATE of: rxn02955.seq check: 3206 from: 1 to: 522
MMNFKSIVCVTAWQVFSRQVLHSPSTWSEELSKLLFVWLSFAGSAFLFGERGHIAVDFIA
RKLPVSAQRVLQVIVQLLIVVFAILGMIWGGYLAASIAWNQQLTALPLTLGWVYVVIPIA
GVFIALFAIIDLIEVATGKEEPYPLVDESEEPRDLDELEAQSAIDSASSAEGRN >RXN02966 TRANSLATE of: rxn02966.seq check: 4215 from: 1 to: 1407
MLFERIYEEGLAQASYFIGCQREGKAIVVDARRDIQTYLDLAAKNNMVISAVTETHIHAD
YLSGTRELAAATGAEIFLSGEGGADWQYGFTGTTLMHNSTIKLGNITITAKHTPGHTPEH
LSFLITDGAVSKDPGFMLSGDFVFVGDVGRPDLLDEAAGGVDTRFAGAQQLFHSLKEQFL
ALPDHIQVYPGHGAGSPCGKALGAIPSTTVGYEKANAWWAPYLRSDDEAGFVEELLDGQP
DAHAYFARMKKQNKQGPAVLSTLSPLVKLEAEEVVEKLGSEAVFVDTREQNQVHLGTVVG
ALNIPRGAKASNFAAWVIDPQKDAQDLIVLAPDANTAADFRDALLRVGIDTVRYFTNSID
GLPTFVPELISPAELAETNYDALIDIRAKSEFAAGSIPGAQQLSGGSAMWRLNELPAGGT
LVTFCQSGARNTVVANALRRAGFTVIELEGSYAAWEKSAANPKNLQTAV >RXN02979 TRANSLATE of: rxn02979.seq check: 3131 from: 1 to: 234
MTAPNTLKQTTLRSDEFSCPSCVSKIENKLNGLDGVDNAEVKFSSGRILVDHDPSKVSIK
DLVAAVAEVGYTAKPSAI >RXN02987 TRANSLATE of: rxn02987.seq check: 9782 from: 1 to: 234
MTAPATLKNTTLRSDEFTCPSCVAKIENKLNGLDGVENAEVKFSSGRILITHDPQKVSVR
DLVTAVAEVGYTAKPSAI
```

Appendix B, page 40

Attorney Docket No.: BGI-125CP

```
>RXN02991 TRANSLATE of: rxn02991.seq check: 416 from: 1 to: 615
MANTVRATVLYDAPGPKGRRFNLIITILTVVLGLALLFWIGSMLSGNGQLDANKWTPFIN
SQTWTTYILPGLWGTLKSAVFSVILALVMGTALGLGRISEIRILRWFCAVIIETFRAIPV
LILMIFAYQMFAQYNIVPSSQLAFAAVVFGLTMYNGSVIAEILRSGIASLPKGQKEAAIA
LGMSSRQTTWSILLPQAVAAMLPAL >RXN02992 TRANSLATE of: rxn02992.seq check: 8686 from: 1 to: 222
IVPLGNTLIALTKNTTIASVIGVGEASLLMKATIENHANMLFVVFAIFAVGFMILTLPMG
LGLGKLSERLAVKK >RXN02993 TRANSLATE of: rxn02993.seq check: 5702 from: 1 to: 672
VAEYVVNSIADDKGWDHPTIEWRESPSAQRETLIQNGEVDMIAATYSINAGRSESVNFGG
PYLLTHQALLVRQDDDRIETLEDLDNGLILCSVSGSTPAQKVKDVLPGVQLQEYDTYSSC
VEALSQGNVDALTTDATILFGYSQQYEGDFRVVEMEKDGEPFTDEYYGIGLKKDDQEGTD
AINAALERMYADGTFQRLLTENLGEDSVVVEEGTPGDLSFLDAS >RXN02996 TRANSLATE of: rxn02996.seq check: 4074 from: 1 to: 669
MNNNVSDQKLSGKELAALEKQAAKTLELGDKKWYLIAGVVLFAIALVLPHIRGVMGWQVL
TLSNVAEDAGITLGEYGFYWLGTIGVFLLSLGTVVFKRTWMAWISWIFSCVTLVFAVFAI
WMRQTTTSTQVNFVNIGMMLAVIAAILAVWGLSSVILARSDRQMEIAEMRAENPDLDGVA
ATQRALLEQQQSNPEDNPLLVDDRRARIARRREREQDAQGEQA >RXN03060 TRANSLATE of: rxn03060.seq check: 6265 from: 1 to: 852
MSNPAASTPANNSDDVAKENWDSSFTPKTDIDSSQPVNNSTGEAAARAVNLYKAYGQGDT
TVTALDHVNVEFEKNKFTAIMGPSGSGKSTLMHCMAGLDAATGGSAFIGDTDLSRLKDKE
MTSLRRDRLGFIFQSFNLVPTLTASENITLPTDIAGRKIDQSWFDEITSRLGLTERLKHR
PAELSGGQQQRVACARALVSRPEIIFGDEPTGNLDSNSSREVLDILRTAVDQDDQTVVIV
THDAKAASYADRVIFLADGRIVNQLFDPTIEEILATMNGIEDIA >RXN03065 TRANSLATE of: rxn03065.seq check: 80 from: 1 to: 393
MISIGTDLVHISAFAEQLAQPGSSFMEVFSAGERRKANERQASRYAEHLAGRWAAKESFI
KAWSQAIYGQPPVIAEEAVVWRDIEVRADAWGRVAIELAPELAAVVRESIGEFSSSLSIS
HDGDYAVERAC >RXN03079 TRANSLATE of: rxn03079.seq check: 7356 from: 1 to: 1017
LSRTGVSKKPKLTAPVVIIGTLVLLIIAFTASLMLGPVTVPLNELATNPVVTDIRAPRII
IAALVGAALAVSGAIMQTVFHNPLADPGIVGVSSGAAVAAVLAIVTGASFFGQWTVPFAA
FVGALVTVAVVYLIASSRAMDGRGADPATLVLVGMAITAFLGAVISSATANAPQDSELRS
VTFWLNGDLVSRTWEHVGVAIIPIIVGLILAIGGSRDLNLLLLGDSTAQTSGLNVNRARI
ILLALAALLTATAVAVSGTITFVGLVVPHLVRIVLGADHRALLPAAAILGATFVIVSDTV
ARMIFSPIVLQTGVVVAFIGSPIFLYLLLSMRKRRGLGL >RXN03080 TRANSLATE of: rxn03080.seq check: 3725 from: 1 to: 780
MPQLVEIRDLNVEFPSRHAVKNVSFSAPAGKVTALIGPNGAGKSTALSAIAGLVESTGEV
MVGGSGVASKSAKARARLLSLVPQNTELRIGFSARDVVAMGRYPHRGRFAVETDADRRAT
DDALRAINALDIAEQPVNELSGGQQQLIHIGRALAQDTAVVLLDEPVSALDLRHQVEVLQ
LLRARANSGTTVIVVLHDLNHVARWCDHAVLMADGEVVSQGDIREVLEPATLSTVYGLPI
AVRDDPETSSLRVIPHPNPF >RXN03081 TRANSLATE of: rxn03081.seq check: 3848 from: 1 to: 459
MKKSLIAIVASALVLSGCTSDSSDSSGTSGTVETTSITTSVAAADGAFPRTVTLDDSSIT
LESKPERIAVLTPEAASLVLPITGADRVVMTAEMDTADEETAALASQVEYQVKNGGRLDP
EQVVAGDPDLVIVSARFDTEQGTIDILEGLNVP >RXN03082 TRANSLATE of: rxn03082.seq check: 9827 from: 1 to: 321
MVMPESAMLTGLIREAGGTPVVDSLGAVGTITADPEQVVAMAPEIIIQDFQGKGRENFA
NFLSNPALANVPAIENDKIFYADTVTTGVTAGTDITTGLQQVAEMLS >RXN03084 TRANSLATE of: rxn03084.seq check: 3960 from: 1 to: 918
MSSRRKLSSALIVLLAAALPLTACSSSEEEASTSSATREFTDAHGTTEVPENPQRVVVL
```

Appendix B, page 41

Attorney Docket No.: BGI-125CP

```
EPLELDTAIALGITPVGAAVANNVTGIPAYLGVDGIEPVGTVSEPNIEAIAALEPDLILG
TDSRHAEIYDRLESIAPTVFMTTHVDPWKDNVVFIGDALGKKQESEDLIQGFNDKCEEIK
SEHDVEGKTVNMIRPRDEQTMSLYGPTSFAGSSLECAGLTIPDQEWKDDLQADIAPENFM
LATADYVFVTATDVTDENELPEVIRENREQFPSLTLVDTSYWVSGVGPLGGSKVLEDIDA
FLDAQQ

>RXN03095 TRANSLATE of: rxn03095.seq check: 5530 from: 1 to: 369
MNADKKMCGMNPDSQYVELAVEVFGLLADATRVRIILALRNSGELSVNHLADIVDKSPAA
VSQHLARLRMARIVSTRQEGQRVFYKLTNEHASQLVSDAIFQAEHTIADGQTPPHHHRER
EQS >RXN03097 TRANSLATE of: rxn03097.seq check: 8524 from: 1 to: 555
ISASAGAIGWLILEYIFKKTTSLLGLLLGALAGLVVITPAAGYVTYLSATIMALIGGICC
YIVINYIKVKLKYHDALDAFGIHGVGGIIGAVLTAVFQSKKANPDIENGFIYTGDIHIIL
VQILCVTAVVIFSIVMTFIIAKVIKLITPLSVTEQETNIGLDKIVHGEHAYFEGELNRFN
KHIRY >RXN03103 TRANSLATE of: rxn03103.seq check: 5397 from: 1 to: 243
MSAKRTFTRIGAILGATALAGVTLTACGDSSGGDGFLAAIENGSVNVGTKYDQPGLGLRN
PDNSMSGLDVDVAEYVIQLHR >RXN03109 TRANSLATE of: rxn03109.seq check: 7721 from: 1 to: 654
MVVKEVDVEKQKAGRVPGAIAKRRTVRIVLFVALGAIVIAASLWSILVGQYTIPIRDLPA
ILASGPTGAQTMAEQVVWQIRMPRIVLGLLVGAALGVAGALLQAVFSNPLAEPSIIGVTS
GAGVGAAAVIVFNLTFLGTSTVAVGAFITAVITTILVYQLARSRGRVQVINLILTGIAIN
AVSGALTSVLDLHRADELPRRNIFCRWVPHGSHGARQR >RXN03110 TRANSLATE of: rxn03110.seq check: 3354 from: 1 to: 1362
VLIERIYDEDLAQASYFIGCQAHNTAVVVDPRRDIAVYLDMAKKNGMEIVGVTETHIHAD
YLSGTRELAAATNATMYVSGEGGADWQYEFDAERICDGSEIRLGNLVLTAVHTPGHTPEH
LSFLLKDGAFADEPGFMLTGDFVFAGDLGRPDLLDEAAGGVDTRFEGARQMFKSLKEKFL
TLPDHIQIFPGHGSGSACGKALGSVPSTTLGYERQFAWWGKYLEADDEQGFIDELLEGQP
DAPAYFGRMKRQNRQGPAIMGARELLPQLEASDLHDVIVVDTRSADEVHQGTVAGAVNIP
AGNSMAKFGSWTVDPEKDSRALVLLAASQIGAMEMWDHMVRVGIDNVAGFITNFDGVDLV
APQTVSPDQLDELEYDLLLDVRNRSEVEEGYIPGALHINGASVLWNLEKLPRDGKIVSYC
KSGTRSSIAASTLRNAGFDVVELQGSYDNWVRHN >RXN03111 TRANSLATE of: rxn03111.seq check: 3457 from: 1 to: 6036
LKTLRAAVAAGAGTNVSDIVERANALLALVADDLIGTLPFGFDPVAWANNSEDPAFDTAQ
SAVSVPGIFVSQIATLDSLEAQRLDVDQAVSSIGHSQGVLGVHLLNDATRADELVAIAQL
IGAAITRTARMTGLIAQGDNMPMLSIAGISREQLQQAIDAACAEVPAEIRPVIGLRNSRD
SYVLVGRPDDNARVVKVIEAMAAKDKKAIEDKLRGGSAFSPRITPLKVQAAFHHPAMNMA
VEQTVAWATTAGLDVELTREIAADVLVNPVDWVARVNEAYEAGARWFLDVGPDGGIVKLT
ANILEGRGADSFYVGDAAGQAKIFDAGMAPELPVDYQEFAPRVEHVDGTPRLVTKFTELT
GRTPMMLAGMTPTTVDPAIVAAAANGGHWAELAGGGQVTPELLETHIAQLTDMLEPGINA
QFNSMFLDPYLWKMQIGGKRLVPKARANGASIDGIVITAGIPEKDEAVALVKELMRDGFP
WIAFKPGAIKQVNSVLAIAKEVPELPIIIQIEGGVAGGHHSWEDLDELLIATYGKVRALD
NVVLCVGGGIGSPERAADYVTGSWSTSYGLPAMPVDGILVGTAAMATKEATTSQAVKELL
VSTQGSDEWVPAGGAKNGMASGRSQLGADIHEIDNSFAKAGRLLDEVAGDETAVQARRDE
IIEAIGKTAKVYFGDIGSMTYEQWLNRYLELSGPVDGQWIDASWAARFAQMLERAEARLI
EQDHGQFEPSLTVEDGVDKLVAAYPHAATDLLTPADVAWFLGLCRTPGKPVNFVPVIDKD
VRRWWRSDSLWQSHDDRYTADQVAIIPGVVAVAGITKANEPVADLLDRFVDATIERIDEH
DSRSRDIMGKVLSSPGTFWAGRNIPSVIHSLGHADKWSRSEFEAFHSPTGANLVYEDAEH
AMLTVPLAGSTAFGTTAELKIRFTSPIDALPSAVPLVTQEDAEAAMGELTRIAAGGTLAT
VNNGTATWETSVDAGVIADYNNVTAGYLPASVVPAHTAPDVLVGRAWPAVFAAVKSAVIP
GTDSASVVEGMLSLVHLEHHIVLKSDVPTDGALKVSATADEVVDTDLGRLVIVRAEIADA
EGNLIATLAERFAIRGRKGNAVARTNTSALPTTVDTPRSARAVATVVAPESMRPFAVISG
DRNPIHVSDVAASLAGLPGVIVHGMWTSAIGELIAGAAFNDEQIQTPAAKVVEYTATMLA
PVLPGEEIEFSVERSAVDNRPGMGEVRTVTATVNGNLVLTATAVVAAPSTFYAFPGQGIQ
SQGMGMEARRNSQAARAIWDRADAHTRNKLGFSIVEIVENNPREVTVAGEKFFHPDGVLY
LTQFTQVGMATLGVAQIAEMREAHALNQRAYFAGHSVGEYNALAAYAGVLSLESVLEIVY
```

Appendix B, page 42

Attorney Docket No.: BGI-125CP

```
RRGLTMHRLVDRDENGLSNYALAALRPNKMGLTADNVFDYVASVSEASGEFLEIVNYNLA
GLQYAVAGTQAGLAALRADVENRAPGQRAFILIPGIDVPFHSSKLRDGVGAFREHLDSLI
PAELDLDVLVGRYIPNLVARPFELTEEFVASMAEVVESTYVNEILADFKAASADKQKLAR
TLLIELLAWQFASPVRWIETQDLLIKGLQAERFVEVGVGSAPTLANMMGQTLRLPQYADA
TIEVLNIERDRPVVFATDEVVREVAVEETPAAPAETTETPATPATPAPVAAAAPATGGPR
PDDISFTPSDATEMLIAIWTKVRPDQMGATDSIETLVEGVSSRRNQLLLDLGVEFGLGAI
DGAADAELGDLKVTVSKMAKGYKAFGPVLSDAAADALRRLTGPTGKRPGYIAERVTGTWE
LGQGWADHVVAEVVIGAREGASLRGGDLASLSPASPASASDLDSLIDAAVQAVASRRGVA
VSLPSAGGAAGGVVDSAALGEFAEQVTGHDGVLAQAARTILTQLGLDKPATVSVEDTAEE
DLYELVSKELGSDWPRQVAPSFDEEKVVLLDDRWASAREDLSALLLANSQQLISMSQAQA
KLLQHKLNSLDLMISQLGSRTKLLGLRRQCCG

>RXN03126 TRANSLATE of: rxn03126.seq check: 1681 from: 1 to: 894
VQEQSKQKDLQADIARITAVKSDTVPNSQSMTFGAAWNDIVRGFKQHELWLQLGWQDIKQ
RYRRSVLGPLWITIATGVMALALGLLYSVLFKIPIAEFLPHVTVGLIIWNFISGCIKEGS
DIFIDNEGLIKQLPSALSVHVYRLVWKQALFLAHNLVIWVILMMIFPRPLGWDVLLIIPA
MFLLVINGVWVVMFFGIIATRYRDVSPLLEAGTQLLFYVTPIVWMTSTLQSQSAEIGNRA
RLAELNPLYHYLEIVRAPMVGADLPAYHWWIVLAFTFVGLGLALLAMKQWRFRVSYWV >RXN03132 TRANSLATE of: rxn03132.seq check: 1885 from: 1 to: 420
MNVNQQLGARTAMNHPETATVLRSISDMVSTETNPRRKSRLEQLIYATASAWPHYPIAHA
AQAAVQLARPMRVFELQSFEGVKHALHHIDLRPALEWDIMGFPESPDTLPILLSDLRDPP
YATTAVPPQSTPRSAHRSTH >RXN03157 TRANSLATE of: rxn03157.seq check: 7995 from: 1 to: 438
GHLDIVTRAAAQFSEVTILVTANPNKNSGLFTVAERMDLIRESTAHLDNVKVDTWASLLV
DYTTEHGIGALVKGLRSSLDYEYELPMAQMNRRLTGVDTFFLLTDEKYGYVSSTLCKEVA
RFGGDVSGLLPEVVAKAVTEKYSNQH >RXN03160 TRANSLATE of: rxn03160.seq check: 3585 from: 1 to: 468
VNRIAEIARSFGVLGFSAFGGPTAHLGYFRTEFVERRRWLDDRQYSEIVALSQLLPGPGS
SQVGMMLGYHRAGFSGMAIAWLMFTWPSLALMAAFALLFDATSASWTLGLLAAAVAVVFK
RSHRAWRGSMASTPGRRPPSGVGLGASRVLGPPQRG >RXN03164 TRANSLATE of: rxn03164.seq check: 9986 from: 1 to: 870
MIYRRVGNSGLKLPAISLGLWHNFGDDKPLSTQRSIIHRAFDRGVTHFDLANNYGPPAGS
AETNFGRILREDLKSHRDELIISSKAGWDMWPGPYGFGGSRKYLVSSLDQSLTRLGLDYV
DIFYHHRPDPDTPLEETMYALRDIVASGKALYVGISSYGPELTAEAAEFMAEEGCPLLIH
QPSYSIINRWVEEPGDDGENLLQSAANNGLGVIAFSPLAQGLLTDKYLDGIPEGSRASQG
KSLSEGMLNVNNIDMVRKLNDIAQERGQSLAQMALAWVLREQREYGAGLP >RXN03183 TRANSLATE of: rxn03183.seq check: 124 from: 1 to: 417
EAEATAGKFEVQPLVGKDGVGVSTLGGYNNGINVNSENKATARDFIEFIINEENQTWFAD
NSFPPVLASIYDDESLVEQYPYLPALKESLENAAPRPVSPFYPAISKAIQDNAYAALNGN
VDVDQATTDMKAAIENASS >RXC00354 translate of: RXC00354.seq check: 80 from: 1 to: 813
MGKLLFVDIGGTLLDYSNEVPRSAVDAIRKARAKGHRVYLSSGRSSAEVTSQLWDIGVDGLIG
ANGGYVESAQESVFHRRLSGEETRHIVEWLYNRGLEFYLESNNGLYASRGFREASKPVLSRLS
EKTDVTVDSMYPDMFWGASLDRDDVNKISYIFNSQEDLDAAREAFPNLEHTTWGGQTGALF
GTIGVSVNKKIGVDRLLKYLNADRANTIAFGDSDEDLSLFEASAYGVAMGEATESLKAAADL
VTDAVGQDGLRNAFLKLELIDA >RXC01748 translate of: RXC01748.seq check: 8341 from: 1 to: 780
MADAKKQADKAAKKQVRAAKKAQRKETRSQMWQVFNMQRKQDKALIPLLLLAILGIPLVLFLIGLIWGG
QWWMLPIGIAAGVVAAMFIFTRRVERDVYKRAEGQQGAAGWAVENLRSGVGMTWRTKTAVAVTTQMDAV
HRVIGLCGVVLVGEGSPHRLKPMLAQQKKRLNRVAPGVPVYEIITGNGEGQTPIAKLQRELVKLPRNYK
KNDVAALAARIEAMDNVGNAPGGSLPKGPLPKGASMSGMNRRARRQAERKGEA >RXC01749 translate of: RXC01749 .seq check: 7382 from: 1 to: 1617
```

Attorney Docket No.: BGI-125CP

```
VSFLVENQLLALVVIMTVGLLLGRIKIFGFRLGVAAVLFVGLALSTIEPDISVPSLIYVVGLSLFVYTI
GLEAGPGFFTSMKTTGLRNNALTLGAIIATTALAWALITVLNIDAASGAGMLTGALTNTPAMAAVVDAL
PSLIDDTGQLHLIAELPVVAYSLAYPLGVLIVILSIAIFSSVFKVDHNKEAEEAGVAVQELKGRRIRVT
VADLPALENIPELLNLHVIVSRVERDGEQFIPLYGEHARIGDVLTVVGADEELNRAEKAIGELIDGDPY
SNVELDYRRIFVSNTAVVGTPLSKLQPLFKDMLITRIRRGDTDLVASSDMTLQLGDRVRVVAPAEKLRE
ATQLLGDSYKKLSDFNLLPLAAGLMIGVLVGMVEFPLPGGSSLKLGNAGGPLVVALLLGMINRTGKFVW
QIPYGANLALRQLGITLFLAAIGTSAGAGFRSAISDPQSLTIIGFGALLTLFISITVLFVGHKLMKIPF
GETAGILAGTQTHPAVLSYVSDASRNELPAMGYTSVYPLAMIAKILAAQTLLFLLI

>RXC01971 translate of: RXC01971.seq check: 8803 from: 1 to: 831
MSKKKPRPIPVPAQFIPGLIDAHTHLASCGGDLAGLVERAKEAGVEKLCTVGDGLAEAELALEAAQQFG
NVFAACAIHPTKADQLDGAARARLTQMAADPNCVAIGETGLDSYWIKHDPEDTAALDVQEEALRWHIDL
AISADKPLMIHNREADADLMRVLADAPPPKDTILHCFSSPLDVAKEALDRGYVLSFAGNVTFKRNEELR
EAARIAPISQILIETDAPYMTPEPFRGSRNEPSLIGHTALCIAEVRGMAVEDVAAALNENFDRVYGVTN
L >RXC02697 translate of: RXC02697.seq check: 1664 from: 1 to: 1527
MTLFQRLTNPVVLGGLAGVLLLLGSFGGGAIRYRGGVLDALGLNFLAFGHAQGISNTVLWVGQLLLIGA
WVHLGRRLFKKKVADDTADAADLGLVKRTLYAMVVPLIFAAPMMSRDVYSYLMQGAMLRDGFDPYTEGA
AVNPGPMLLEVSHDWRNTTTPYGPLHLWIGDMITTVVGDNVTLGVVAYKILSIIGLAVTGWSIVRIAQH
FGANPAIALWIGVANPVMIIHMIGGMHNESLMVGLVSVGLLLALKKRFVAGVALIAVAVSLKATAAIAL
PFVVWIGMHHFAGFLATKKGKDSPTLKQQVPAFFATGAAGVAVTGVVVSAITWASGASWGWISEISGNS
KVINPLAFPSLVASVITMVAEVFVDDFDYNAVVNVVRSISMLIMLGGLVVCWWLFRQNERRAVTGTAAA
YAVAFVFNSVTLPWYYASLISLLGTFKPPMWLIRFAAGASVFIALMFTGSGNHQLYNIVTVIIAAIIAW
LATVVIFDDTDPATTATEKPSPHTVS >RXS00148 translate of: RXS00148.seq check: 5482 from: 1 to: 2211
MTSIPNFSDIPLTAETRASESHNVDAGKVWNTPEGIDVKRVFTQADRDEAQAAGHPVDSLPGQKPFMRG
PYPTMYTNQPWTIRQYAGFSTAAESNAFYRRNLAAGQKGLSVAFDLATHRGYDSDNERVVGDVGMAGVA
IDSILDMRQLFDGIDLSSVSVSMTMNGAVLPILAFYIVAAEEQGVGPEQLAGTIQNDILKEFMVRNTYI
YPPKPSMRIISNIFEYTSLKMPRFNSISISGYHIQEAGATADLELAYTLADGIEYIRAGKEVGLDVDKF
APRLSFFWGISMYTFMEIAKLRAGRLLWSELVAKFDPKNAKSQSLRTHSQTSGWSLTAQDVYNNVARTA
IEAMAATQGHTQSLHTNALDEALALPTDFSARIARNTQLLLQQESGTVRPVDPWAGSYYVEWLTNELAN
RARKHIDEVEEAGGMAQATAQGIPKLRIEESAARTQARIDSGRQALIGVNRYVAEEDEEIEVLKVDNTK
VRAEQLAKLAQLKAERNDAEVKAALDALTAAARNEHKEPGDLDQNLLKLAVDAARAKATIGEISDALEV
VFGRHEAEIRTLSGVYKDEVGKEGTVSNVERAIALADAFEAEEGRRPRIFIAKMGQDGHDRGQKVVASA
YADLGMDVDVGPLFQTPAEAARAAVDADVHVVGMSSLAAGHLTLLPELKKELAALGRDDILVTVGGVIP
PGDFQDLYDMGAAAIYPSGTVIAESAIDLITRLAAHLGFDLDVDVNE >RXS00149 translate of: RXS00149.seq check: 63 from: 1 to: 1848
LTDLTKTAVPEELSENLETWYKAVAGVFARTQKKDIGDIAVDVWKKLIVTTPDGVDINPLYTRADESQR
KFTEVPGEFPFTRGTTVDGERVGWGVTETFGHDSPKNINAAVLNALNSGTTTLGFEFSEEFTAADLKVA
LEGVTLNMAPLLIHAGGSTSEVAAALYTLAEEAGTFFAALTLGSRPLTAQVDGSHSDTIEEAVQLAVNA
SKRANVRAILVDGSSFSNQGASDAQEIGLSIAAGVDYVRRLVDAGLSTEAALKQVAFRFAVTDEQFAQI
SKLRVARRLWARVCEVLGFPELAVAPQHAVTARAMFSQRDPWVNMLRSTVAAFAAGVGGATDVEVRTFD
DAIPDGVPGVSRNFAHRIARNTNLLLLEESHLGHVVDPAGGSYFVESFTDDLAEKAWAVFSGIEAEGGY
SAACASGTVTAMLDQTWEQTRADVASRKKKLTGINEFPNLAESPLPADRRVEPAGVRRWAADFEALRNR
SDAFLEKNGARPQITMIPLGPLSKHNIRTGFTSNLLASGGIEAINPGQLVPGTDAFAEAAQAAGIVVVC
GTDQEYAETGEGAVEKLREAGVERILLAGAPKSFEGSAHAPDGYLNMTIDAAATLADLLDALGA >RXS00948 translate of: RXS00948.seq check: 5347 from: 1 to: 1119
MANVVLVDRMEPLVSKLFTPIQIRDITIPNRVWMSPMCTYSAATGSGLPTDFHQAHYAARAAGGVGLVM
VEATGVNPVAPISPVDLGLWSHDQIEPFSRVTAAIRAGGAVPAVQLAHAGRKASTDAPWNGGGYVGPET
NGWETVGPSPLAFPGLPAPRELTVSEIQEVVQQFAGAAVRADQAGFDVVEIHAAHGYLLHNFLSPISNK
RTDSYGGSLENRARIVLEVIDAIRAVWPEEKPVFMRISTTDDWVEENPQDDRESWTLSQSRQLALWASEH
GVDLIDASSGGLDIVPIPHDRDYQTAKAADLHASTGVTVAAVGRIDDAQTAHNLVDSGDVNAVFLGRPL
LKDPSWANQAALALGAEPRYVHQYDYVL >RXS01166 translate of: RXS01166.seq check: 5407 from: 1 to: 1305
MGYTNLNDTRVLRAGSCDAWWRTMSPLVQQGSEAVFRRIMGLSRRPDRKPGFDDVPHFGAAVRVPGLKH
GTLVNAAPLKVLGARGEPNASSYRFEYITGDSAGRAITATGAVLFSTRPWTTGPRPAIAMAPSTQGVA
```

Appendix B, page 44

Attorney Docket No.: BGI-125CP

```
QHCDPSHTCAIGLNAFYDKPFDAIIAYELPVILWFLAHGLDVVFIDYPRDPATGVQYYCDSIAAAKSLL
DAVLASRQLGLSPEAPLGLWGFSQGGGATGWAAQLQDYAPDVRPKAAVVGAPPVDLFRVLDTVDGGLLT
GVIAYAIAGLAVNSSEMFEEIMSVLNERGVSDVLKNITSCAGGSLLASGYSSSRGWTHQGTPLADILDD
LPLVVAEFGKQKLGRVAPEIPVLLWGSKNDDVIPIDPIRELRDSWADKGTPLTWHESQAPRVPGRTGLN
HFGPYFRNLEKYSGWLIDHLV

>RXS01746 translate of: RXS01746.seq check: 830 from: 1 to:  753
MTAPRDPFFPADLSIRASAEPIEIQRLGLIDYQEAWDYQAELATRRANDEIPDQLLILEHPSVYTAGKR
TQPEDLPTNGLPVINADRGGRITWHGPGQLVIYPIIKLADPIDVVDYVRRLEEALIQVVGDMGVAGAGR
IDGRSGVWVPAHDGWVDSKVAAIGIRITRGVAMHGVAINCNNTLDFYEHIIPCGIADAGLSTLSRELKR
DVSVEELVEPSIRALDDALAGRLVVSDHSFGSAPDPTKNLPKRG >RXS01747 translate of: RXS01747.seq check: 6480 from: 1 to: 1044
VTIAPEGRRLLRVEARNSETPIETKPRWIRNQVKNGPEYQDMKERVAGASLHTVCQEAGCPNIHECWES
REATFLIGGANCSRRCDFCMINSARPEPLDRGEPLRVAESVREMQLNYSTITGVTRDDLDDEGAWLYSE
VVRKIHELNPHTGVENLVPDFSGKKDLLQEVFESRPEVFAHNVETVPRIFKRIRPAFRYERSLDVIRQA
RDFGLVTKSNLILGMGETKEEITEALQDLHDAGCDIITITQYLRPGPLFHPIERWVKPEEFLEHADAAK
EMGFAAVMSGPLVRSSYRAGRLYAQAMEFRGEEIPAHLAHLKDTSGGSTAQEASTLLERYGASEDTPVV
SFN >RXS01879 translate of: RXS01879.seq check: 6847 from: 1 to:  933
VKITAKAWAKTNLHLGVGPAHDDGFHELMTVFQTIDLFDTVTLTTLDEELVEEGSVVKQLSVTGARGVP
EDASNLAWRAVDALVKRRAEKTPLSAVSLHISKGIPVAGGMAGGSADAAATLRAVDAWIGPFGEDTLLE
VAAELGSDVPFCLLGGTMRGTGRGEQLVDMLTRGKLHWVVAAMAHGLSTPEVFKKHDELNPESHMDISD
LSAALLTGNTAEVGQWLHNDLTSAALSLRPELRSVLQEGIRSGAHAGIVSGSGPTTVFLCESEHKAQDV
KEALIDAGQVYAAYTATGPAASTADQRGAHILTVS >RXS02023 translate of: RXS02023.seq check: 8728 from: 1 to:  768
MAPKQTPSPEKNRNLVGPVLQRRQTEGTFDQRLLEMRADHNWKHADPWRVLRIQSEFVAGFDALHEMPK
AVTVFGSARIKEDHPYYKAGVELGEKLVAADYAVVTGGGPGLMEAPNKGASEANGLSVGLGIELPHEQH
LNPYVDLGLNFRYFFARKTMFLKYSQAFVCLPGGFGTLDELFEVLCMVQTGKVPNFPIVLIGTEFWAGL
VDWIRHRLVEEGMIDEKDVDRMLVTDDLDQAVKFIVDAHAGLDVARLHN >RXS02106 translate of: RXS02106.seq check: 9598 from: 1 to: 1056
MNNHFELKVPGGKLVVVDVTTDLDSIADVKISGDFFLEPDEAFFALGRALQGASVGDNTDRLQAKLDAA
LAEYDDVELHGFSTADIALAVRRAVTGAQDFTDYEWEILHPGVLPTPLNVALDELLLDQVASGQRGPTM
RIWDWDDRATVIGSFQSYVNEINQEGVNEHGVTVVRRMSGGGAMFMEGGNCITYSLYAPESLVAGLSYE
QSYEYLDRWVIAALKTHDVDAWYVPINDITSTGGKIGGAAQKRRSGAVLHHVTMSYDIDADMMTQVLRI
GKVKISDKGLRSAKKRVDPLRRQTGASREQIIDTLKSTFSARYGAQEVELSDEDFAAGHDLVKTKYATE
EWTKRVQ >RXS02228 translate of: RXS02228.seq check: 9755 from: 1 to:  903
VVTPIAVVGPTASGKSALGIALAHKLDGEVVNVDSMQLYKGMDIGTAKLTVEEREGIAHHQLDVWDVTE
TASVARFQSDAVADVEDIMSRGKTPILVGSMLYVQSLVDDWQFPPTDSAVRARFEARLADIGVEALHA
ELTQLDPEAAAVIESNDPRRTVRALEVIELTGQPFQASQPPKDAPPRWGTRIIGLKTTPEWLNPRIEQR
TARMFEQGFVAEVEHLVQQGLIADSTAGRAIGYSQVLAAMAGEMTWEDAFERTVTGTRRYVRRQRSWFN
RDHRVSWVDASGDPTAQALEILGLQ >RXS03212 translate of: RXS03212.seq check: 3878 from: 1 to: 1452
ASLNWSVIVPALVIVLATVVWGIGFKDSFTNFASSALSAVVDNLGWAFILFGTVFVFFIVVIAASKFGT
IRLGRIDEAPEFRTVSWISMMFAAGMGIGLMFYGTTEPLTFYRNGVPGHDEHNVGVAMSTTMFHWTLHP
WAIYAIVGLAIAYSTFRVGRKQLLSSAFVPLIGEKGAEGWLGKLIDILAIIATVFGTACSLGLGALQIG
AGLSAANIIEDPSDWTIVGIVSVLTLAFIFSAISGVGKGIQYLSNANMVLAALLAIFVFVVGPTVSILN
LLPGSIGNYLSNFFQMAGRTAMSADGTAGEWLGSWTIFYWAWWISWSPFVGMFLARISRGRSIREFILG
VLLVPAGVSTVWFSIFGGTAIVFEQNGESIWGDGAAEEQLFGLLHALPGGQIMGIIAMILLGTFFITSA
DSASTVMGTMSQHGQLEANKWVTAAWGVATAAIGLTLLLSGGDNALSNLQNVTIVAATPFLFVVIGLMF >RXS03220 translate of: RXS03220.seq check: 3878 from: 1 to:  960
MGLREILSSKWLVRILLVGIGLGVAQQLTGINSIMYYGQVVLIEAGFSENAALIANVAPGVIAVVGAFI
ALWMMDGINRRTTLITGYSLTTISHVLIGIASVAFPVGDPLRPYVILTLVVVFVGSMQTFLNVATWVML
```

Appendix B, page 45

Attorney Docket No.: BGI-125CP

SELFPLAMRGFAIGISVFFLWIANAFLGLFFPTIMEAVGLTGTFFMFAGIGVVALIFIYTQVPETRGRT
LEEIDEDVTSGVIFNKDIRKGKVH

SEQUENCE LISTING (678 sequences)

SEQ ID NO: 1 - DNA, 578 bp, Corynebacterium glutamicum
  CDS (1)..(555): RXN03097
atttcagccagtgcaggtgctataggttggttaattttagaatatatttttaaaaagacgacaagtttacttggacttttactcggtgcattagcaggattagttgttattactcctgcagcaggatatgtaacatatcttagtgcaacaataatggctttaataggaggtatctgttgttatattgtcattaattacatcaaggtaaaactaaaatatcatgatgcattagatgcatttggtattcatggtgttggtggtattattggtgctgttttaacagcagttttccaaagtaaaaaagccaatcctgacattgagaatggctttatttatactggtgacatacatattatacttgtacaaatattatgtgtaacagcagttgtaatttttagtatcgtcatgacgtttattattgcgaaagtaattaaattaattacaccattatctgttacggaacaagaaacgaatataggattagacaagattgttcacggtgaacatgcttactttgaaggtgagctaaatagattcaataaacatattcgatattagaatatatttacatagaatat

SEQ ID NO: 2 - protein, 185 aa, Corynebacterium glutamicum
ISASAGAIGWLILEYIFKKTTSLLGLLLGALAGLVVITPAAGYVTYLSATIMALIGGICCYIVINYIKVKLKYHDALDAFGIHGVGGIIGAVLTAVFQSKKANPDIENGFIYTGDIHIILVQILCVTAVVIFSIVMTFIIAKVIKLITPLSVTEQETNIGLDKIVHGEHAYFEGELNRFNKHIRY

SEQ ID NO: 3 - DNA, 373 bp, Corynebacterium glutamicum
  CDS (101)..(373): RXA02099
tagttagagctggttcaaggggtgtcaatcccaaaaggcactccttgaactcatgaaaaagcttgacaaaacttcaacgtcaaaggaggtcatccacgctatgggtgcagatcaaattgcagcagtctccggcaattcagcttggatgctgatgtccgcgtcgctcgtgctgctaatgacaccagcactggcacttttctatggcggcatgtctcgtcaaaagtccgtgctcaacatgatgatgatgtcctttggagcattgggcgtcgttactgttatttacctcttgtggggatggtcgatgtcttatggaacccaatcaatcgcgggaatctttgctaacccttttgagttcttcggtcttaaagattcc

SEQ ID NO: 4 - protein, 91 aa, Corynebacterium glutamicum
MGADQIAAVSGNSAWMLMSASLVLLMTPALALFYGGMSRQKSVLNMMMMSFGALGVVTVIYLLWGWSMSYGTQSIAGIFANPFEFFGLKDS

SEQ ID NO: 5 - DNA, 879 bp, Corynebacterium glutamicum
  CDS (101)..(856): RXA00104
tgcaaagacatcccggaaccactccgctacttgaggtcggaatcgggaaagaatgcttttagccatgccttaatgtaaccaaacatctagaattgagaacatgactgctcagattgatgattcgatcctcacccatcgtctcgcccaaggcaccggagaaatcctcaaaggtgtccgcaatgttggggtgttaagaggtcggaatctcggtgatgccggcgacgaactcgcacaaagttggattgctcgagtgttggagcagcaccgccccaacgatggattcctgtctgaagaagccgccgacaacccagaccgcctatccaaggaccgcgtgtggatcatcgatcccctcgacggcaccaaagaattcgccaccggccgccaggactgggcagtacacatcgcactggtagaaaacggtgttcccacccacgccgctgttggcctccccgaccttggcgtggtgttccactccgctgatgcccgcgccgtgactggcccttactccaaggtcatcgccatctcccacaaccgcccaccaaaggttgctctatcttgcgcagagcagctcggctttgaaaccaaggcccttggatccgcaggcgctaaagcaatgcacgttctcctcggtgactacgacgcctacatccacgccggcggccaatacgagtgggattccgcagcaccagtcggcgtctgcaaggcagcaggcttgcactgctccaggctcgacggttccgagctgacctacaacaacaaagacacctacatgccagacatcttgatctgtcgccctgaacttgcagatgaacttctcgagatgtgcgcgaagttctacgaggagaatggaacttactaacgctgttatgatgacggcat

SEQ ID NO: 6 - protein, 252 aa, Corynebacterium glutamicum
MTAQIDDSILTHRLAQGTGEILKGVRNVGVLRGRNLGDAGDELAQSWIARVLEQHRPNDGFLSEEAADNPDRLSKDRVWIIDPLDGTKEFATGRQDWAVHIALVENGVPTHAAVGLPDLGVVFHSADARAVTGPYSKVIAISHNRPPKVALSCAEQLGFETKALGSAGAKAMHVLLGDYDAYIHAGGQYEWDSAAPVGVCKAAGLHCSRLDGSELTYNNKDTYMPDILICRPELADELLEMCAKFYEENGTY

SEQ ID NO: 7 - DNA, 875 bp, Corynebacterium glutamicum
  CDS (101)..(859): RXA01420
cgaagttcacgactacaggcattacctgggtgctgattttgcgcgagtaaagctgtggctgcggaatgcgctgctcatccacacgtggaatcctgattgggtgacgctgggtggattgaatgtaccatcgtggtcgctgggcgcggaaatgctgttctacctgacgttcccgctgtttattccgttagtgcgcaaagtgaagggcgtgggcaactggtgggcatttggcatcacctttgccgtgagcctggcgctgattacagtgattcacttttatgcggacggaccaaaggggattgagaacttctttgttcctcgcctgtgggacaccaatgtgtcaccggtcgcggaagttcacgccgatccagtgtggtttatgcaggaagaaattcccgtgctggaatcttactggctgtcttactacttcccgctgaccagactcatcgagttctacctcggtgtgtttggcgcgaagctggttgctgaaggcatgtttaaaaacaccaacatcaccatcccgctgatcgcactggctgtttcttttgttgctacttggtttgtgccactggcattcaagatgtctgtcatcatgtccctgccaatggcttttgttgtggcaacgcttgcggtgagagacattgaaggcaagagtggggaaatcgcctcgcctcgcgcagttttgttgggtaatatttcctttgccttctacatggtgcaattccccgtcatggtgtttgtgcagcgctatttcattgctggcaaagaatacggcttccttggctgggcattctatgcagtggtgtgtttcatcgtgtcggtcattctcgcgtgggtgctgttaccttcgttgatgatcctttaataaggccacggaa

SEQ ID NO: 8 - protein, 253 aa, Corynebacterium glutamicum
VTLGGLNVPSWSLGAEMLFYLTFPLFIPLVRKVKGVGNWWAFGITFAVSLALITVIHFYADGPKGIENFFVPRLWDTNVSPVAEVHADPVWFMQEEIPVLESYWLSYYFPLTRLIEFYLGVFGAKLVAEGMFKNTNITIPLIALAVSFVATWFVPLAFKMSVIMSLPMAFVVATLAVRDIEGKSGEIASPRAVLLGNISFAFYMVQFPVMVFVQRYFIAGKEYGFLGWAFYAVVCFIVSVILAWVLLPSLMIL

SEQ ID NO: 9 - DNA, 1983 bp, Corynebacterium glutamicum
  CDS (101)..(1960): RXN02581
acggtcactcgctcaagtagtgttagtttgcaaaagtaataaaatgttcatctttgtcgatggtcacaatagtcattaaagaattgtaagaggggttcacatggatttagataaagcgattggttcattcttcgatgagaatggagaaatcaaccttcctccattcctaactttggcagccatgggtgagttcatgtaccaggctgacatcgctgaaggcggcggggataaaccacgcatgcatttctgggacttctccgaagaccgcgatggcaagctgattcagtacacccgaaacgagatcgatactcgtatcaaggctgtagcaggccgtttgcagcaggtcgccaccctgggtgatcgtgcagcgatcctggctaacaacagccctgagtacattttcagcttcctcggcgcgatctacgctggcatggtccctgtgccgctttatgatccaaacgagccaggacacgcagaccacctcaacgctgttttcgcagacagcgagccagttgtcgttctgaccaactccaagtccgcaggtgccgtgcgcaagcacttctccagccttccagctgcagaacgcccacgcatcctctctgtagattccttgcctgattctctcgcggattcttacgagaacccaatgctgaccgaagccggccgccgcctggctgctctgcgccagtccgcgcccattgatctgaccgcattcctgcagtacacctccggctccacccgaaccccagctggcgttgttctgaccaaccgctccatcctgaccaacgtcttgcagatcttcagcgccgcacagctgaaaaccccactgcgcctggtttcatggctgccactgcaccacgacatgggcattatcctcgcggcgtttgtcactatgcttggcctggacaacgagttcatgaacccacgcgatttcgtgcagcagccttcccgctggattaagcagctcaaccgtcgcgaaagcgacgtggacgttaacgtctacaccgtggttcctaacttcgccctcgagcttgcagcacgctacgcaaagccagcagagggagagaccctggatctttccgcattggatgccatcattatcggttccgagccagtcacagaaaacgctctgaccaccttccgtgaagctttcgagccttacggcctgcctgttcagaccctgcgtccttcctacggtcttgcagaagcatccctgctggtcaccaccccacagaccgaaaaccgcccactgatctcctacttcgaccgcgaggccttggccgaaaaccgcgttgagcttgtagaaaagggcaataacaaggctgttgctttcgtctccaacggccaggttgcagccccacagcagctggtcatcgttgattccgaaaccggaaccgagctggcagacggccagatcggcgaaatctggacccacggcgaaaacactgctgcaggttacctcgaccgcgaggaagacaccgcagaaaccttccgcaaccgtctgaccacccgcctggaagaaaactcccgcgcagaaggtgctgccgacgacaactactggatggccaccggtgacctcggcgtcatcgtagacaacgagctctacatcaccggtcgtctgaaggacctcatcgttgtcgcaggccgaaaccactacccacaggacatcgagtacaccgtccaggctgcttccgcacacatccgtgcagattccgtcgcagcattcgcagtcccaggcgatgacattgaaaagctcatcatcctggcagaacgcgacaccactgcaaacgaagccgacgatgcagctgctgaagaagcaatccgctccgccgttggcactgcacacggtgttgttccagaagagatccgtatcctcgcacctgacgagatcgcgcgttcctcctccggaaagatcgcacgccgcgtcaaccagcgcaactacattcaggaacaagctaactagttctttgcagacaccgcagg

SEQ ID NO: 10 - protein, 620 aa, Corynebacterium glutamicum
MDLDKAIGSFFDENGEINLPPFLTLAAMGEFMYQADIAEGGGDKPRMHFWDFSEDRDGKLIQYTRNEIDTRIKAVAGRLQQVATLGDRAAILANNSPEYIFSFLGAIYAGMVPVPLYDPNEPGHADHLNAVFADSEPVVVLTNSKSAGAVRKHFSSLPAAERPRILSVDSLPDSLADSYENPMLTEAGRRLAALRQSAPIDLTAFLQYTSGSTRTPAGVVLTNRSILTNVLQIFSAAQLKTPLRLVSWLPLHHDMGIILAAFVTMLGLDNEFMNPRDFVQQPSRWIKQLNRRESDVDVNVYTVVPNFALELAARYAKPAEGETLDLSALDAIIIGSEPVTENALTTFREAFEPYGLPVQTLRPSYGLAEASLLVTTPQTENRPLISYFDREALAENRVELVEKGNNKAVAFVSNGQVAAPQQLVIVDSETGTELADGQIGEIWTHGENTAAGYLDREEDTAETFRNRLTTRLEENSRAEGAADDNYWMATGDLGVIVDNELYITGRLKDLIVVAGRNHYPQDIEYTVQAASAHIRADSVAAFAVPGDDIEKLIILAERDTTANEADDAAAEEAIRSAVGTAHGVVPEEIRILAPDEIARSSSGKIARRVNQRNYIQEQAN

SEQ ID NO: 11 - DNA, 1550 bp, Corynebacterium glutamicum
  CDS (1)..(1527): FRXA02581
gtccctgtgccgctttatgatccaaacgagccaggacacgcagaccacctcaacgctgttttcgcagacagcgagccagttgtcgttctgaccaactccaagtccgcaggtgccgtgcgcaagcacttctccagccttccagctgcagaacgcccacgcatcctctctgtagattccttgcctgattctctcgcggattcttacgagaacccaatgctgaccgaagccggccgccgcctggctgctctgcgccagtccgcgcccattgatctgaccgcattcctgcagtacacctccggctccacccgaaccccagctggcgttgttctgaccaaccgctccatcctgaccaacgtcttgcagatcttcagcgccgcacagctgaaaaccccactgcgcctggtttcatggctgccactgcaccacgacatgggcattatcctcgcggcgtttgtcactatgcttggcctggacaacgagttcatgaacccacgcgatttcgtgcagcagccttcccgctggattaagcagctcaaccgtcgcgaaagcgacgtggacgttaacgtctacaccgtggttcctaacttcgccctcgagcttgcagcacgctacgcaaagccagcagagggagagaccctggatctttccgcattggatgccatcattatcggttccgagccagtcacagaaaacgctctgaccaccttccgtgaagctttcgagccttacggcctgcctgttcagaccctgcgtccttcctacggtcttgcagaagcatccctgctggtcaccaccccacagaccgaaaaccgcccactgatctcctacttcgaccgcgaggccttggccgaaaaccgcgttgagcttgtagaaaagggcaataacaaggctgttgctttcgtctccaacggccaggttgcagccccacagcagctggtcatcgttgattccgaaaccggaaccgagctggcagacggccagatcggcgaaatctggacccacggcgaaaacactgctgcaggttacctcgaccgcgaggaagacaccgcagaaaccttccgcaaccgtctgaccacccgcctggaagaaaactcccgcgcagaaggtgctgccgacgacaactactggatggccaccggtgacctcggcgtcatcgtagacaacgagctctacatcaccggtcgtctgaaggacctcatcgttgtcgcaggccgaaaccactacccacaggacatcgagtacaccgtccaggctgcttccgcacacatccgtgcagattccgtcgcagcattcgcagtcccaggcgatgacattgaaaagctcatcatcctggcagaacgcgacaccactgcaaacgaagccgacgatgcagctgctgaagaagcaatccgctccgccgttggcactgcacacggtgttgttccagaagagatccgtatcctcgcacctgacgagatcgcgcgttcctcctccggaaagatcgcacgccgcgtcaaccagcgcaactacattcaggaacaagctaactagttctttgcagacaccgcagg

SEQ ID NO: 12 - protein, 509 aa, Corynebacterium glutamicum
VPVPLYDPNEPGHADHLNAVFADSEPVVVLTNSKSAGAVRKHFSSLPAAERPRILSVDSLPDSLADSYENPMLTEAGRRLAALRQSAPIDLTAFLQYTSGSTRTPAGVVLTNRSILTNVLQIFSAAQLKTPLRLVSWLPLHHDMGIILAAFVTMLGLDNEFMNPRDFVQQPSRWIKQLNRRESDVDVNVYTVVPNFALELAARYAKPAEGETLDLSALDAIIIGSEPVTENALTTFREAFEPYGLPVQTLRPSYGLAEASLLVTTPQTENRPLISYFDREALAENRVELVEKGNNKAVAFVSNGQVAAPQQLVIVDSETGTELADGQIGEIWTHGENTAAGYLDREEDTAETFRNRLTTRLEENSRAEGAADDNYWMATGDLGVIVDNELYITGRLKDLIVVAGRNHYPQDIEYTVQAASAHIRADSVAAFAVPGDDIEKLIILAERDTTANEADDAAAEEAIRSAVGTAHGVVPEEIRILAPDEIARSSSGKIARRVNQRNYIQEQAN

SEQ ID NO: 13 - DNA, 4953 bp, Corynebacterium glutamicum
  CDS (101)..(4930): RXA02582
tggatgtctattctcctcagcctcgttttggttgaggcggatagttttaatatttttttaagtttaagttgtaatcgagctgaaaggctgaggcctcaatatggaacagagccaatcgtcggatcagaagatgaccgttgaacaggttcgcacctggctccgtgattgggttgtccgcaccacgggtattccggtggaggaagttacggatgacaaggcaatggagacctttggcctttcctctcgcgatgttgttgtgttgtctggtgagctggaaaacctgctggacacctccttggatgccaccatcgcttatgagtacccaacgatccgtagtttggcgcagcgccttgttgagggcgagcctcgtcgtgcacatacccagcgtgaattgaatttctccgcggtgagcgattccccaggttcccacgatattgcggttgtcggtatggctgcgcgttacccaggcgctgagagcctggaggatatgtggaagctactcgtcgagggccgtgacggtatctcggatctaccgattggccgttggtctgagtatgcaggcgatgaggttatgtctcggaagatggaagagttttctaccatcggtggctacctgtcagatatctctagctttgatgcggagttctttggtctgtctccgctcgaggccgccaacatggatcctcagcagcgtattttgctggagctaacgtgggaggctttggagtacgctcgcatcgcaccaaacactttgcgtggcgaagccgtgggcgtgttcataggttcctccaacaacgattacggcatgatgatcgctgccgatccagcagaagcacatccttatgcgctgactggtacttctagtgcgattgtcgctaaccgcattaactacgctttcgatttccgcggtccttccgtcaacgtggataccgcatgttcttcttctctggtagcggttcaccaggctgtccgtgcgctgcgtaatggcgaagcggatcacgctatcgctggtggagtgaacattttggcatctccatttgtcacaactgcattcgctgagctcggtgtgatcagcccaaccggcaagatccacgcattctctgatgatgccgatggtttcgtgcgttccgacggcgccggagtcgttgtgctgaagcgcgtggatgacgcaatccgcgacggcgacaagatcatcggtgtgatcaagggttctgcagtgaactccgatggtcactccaacggactgaccgctccaaaccctgacgcacaggttgatgtgctgcagcgtgcatatgttgacgctcaggttgatcccaccaccgtggattacgttgaggctcacggcaccggcaccatcctgggtgaccccattgaagcaactgccctgggtgctgttttgggctatggccgtgacgcatccaccccaactcttctgggctctgcaaagtccaacttcggccacactgagtcagctgcgggtattgcaggtgtcatcaaggtgctgcttgctttgcagaacaagactctgccaccaaccgtgaactttgcaggtccaaaccgctacatcgatttcgatgctgagcgtttggaagttgtggaagatccacgtgaatggccggaatacaacggtcacgcagtagctggtgtgtctgcgttcgggttcggtggaaccaacgcgcacgtggtgatctctgagtacaacgcagaagactacgaaacccgtgccccgaaggaggcgttgcttcctgaccagcaggttgccctgccggtgtctggtcacctgccatccaggcgtcgacaagcagctgctgacttggcggacttcttggagggccgcaaagattgcgacctaaccccagtagcccgcgcgctggcaggccgcaatcatggccgctcccgcgcagtcgtgcttgcaagcactatcgaggaagccgtaaagcgcctgcgccaggtcgcagaaggcaaggtcagcgtcggtatctccgcagctgattccccagcggccaacggtcctgtgtttgtgtactccggtttcggatcccagcaccgcctcatgatcaaggaattgtgctcaatttcgccacagttccgcgagcgcatcgaagagctcgatgaaatggttaagttcgagtccggctggtccatcatgaaacttgttttggatgatgagcaaacttacgacaccgagaccgcgcaggttgtgatcaccgcaatccagatcgcactgactgacctgttggcaagcttcggtgtaaagccagctgccgtcatgggcatgtcgatgggtgagatcgctgccgcttacgctgccggtggactcagcgaccgcgataccatgctcattgccagccaccgttcccgcctaatgggcgagggcgagaagtccctggctgaggatcagctgggtgccatggctgtggtggaattcgccgctgcggacctggataagttcatcgaagaaaaccctgagtacaagggcattgagcctgctgtttatgcaggcccaggcatgactaccgtgggtggacctcgcgacgccgtggttcagttcgtagagaagctggaatctgaagacaagtttgcccgcctgctcaacgtcaagggcgctggccacacctctgctgtggaaccacttcttggtgagctcgctggcgaaatcgctggcatcgagccacttccgctgcagatcccgttgttcagctctgtcgatcagggtgttacctacccagttggagcagtggtccacgacgccgattacatgctccgctgtacccgccagtccgtgtacttccaggactccaccgaagctgcattcgctgcaggccacaacaccttggtggaaatttccccgaacccagttgcactcatgggcatgatgaacaccgcgttcaccgtgggcaagcctgatgcacagctgctgttcagcctgaagcgaaaagtcccagaggcagaatccctccgcgaccttctggcgaagctgtacgtcaacggcgcaaacgttgatttctccgcgctgtacggcgaaggtgaaaccatcgatccgccacacatcacctggaagcaccagcgcttctggacttccgcacgcccatcctctggcgcatccctggatctgccgggcttccgcgtgaatctgccaaacaacactgtggcgttttccaccgcagccgaactggcaccatccgcagtggcaatcatggaagcagccgccatggctgtcaccccaggttcctccgtcgacgcagtggacgagcgcgacatgctgccaccaagcggcgaaatcaccaccatcgtgactcgctccttgggcggtttgagcctgtccgtatacaagattgagggaaccaccagcactcttgtcgccgaaggtttcgcagccaacccaggattcgccgcagcatcttccttcgacggtccaggctacgacggattcaacaccgattacagcgaccagccagaccctcgctccgacctgcctttggacatcgaagcagtccgctgggacccagcgaccgaaaccgtcgaagagcgcatgcgcgccatcgtctccgaagcaatgggctacgacgtggatgacctcccacgcgaactcccactgattgacctcggcctcgactccctcatgggcatgcgcatcaaaaaccgcatcgaaaatgacttccagatcccaccactccaggtccaagcgctccgcgatgcatccgtcgctgacgtggtaatcatggtggaaaacatggtcgctggccgctcctctgagacgcttgtcgacgccaccccgcaggtgccagctgaggcagcaggggaggctcaagctgctgagtcttctgcttcgggcgaggacgtgcagggcgttggcgttgcaccgcgagatgcgtcggaacgcatggtctttggtacttgggcaggcctgactggcgctgcggcagctggcgtgaccagcaagttgccacagatcgatgtcgatactgcaaccgcaattgccgagcgcctcaccgagcgttccggaattgaaatcagcactgaacaggtgttggctgcagaaaccctcgaaccactgtctgacctggtgcgtgaaggcctcgaaactgaagttcagggcaacattcgtgtgctgcgtggacgtgcagaaggctccaccaagcctgcagtgttcatgttccacccagctggcggttcttccgtggtctaccaaccactaatgcgtcgtctgcctgaagatgtccctgtctatggcgttgagcgtctggaaggcgatctcgctgaccgcgcggcagcatatgttgatgacatcaagaagtactccgatggcttcccagtagttttgggtggctggagcttcggcggtgccgttgccttcgaggttgcccaccaactggttggctccgatgttgaggtagctaccgtggcgttgctggatactgtgcagccttcaaacccagcaccagataccgctgaggaaactcgtgcacgctggactcgctacgcggacttcgccaagaagacctacggccttgatttcgaggtaccttttgaaatcttggacaccatcggtgaagacggaatgctgtccatgatgaccgacttcctggccaacaccgacgcctccgagcacggattgtccgcaggtgtgcttgaacaccagcgcgcttcttttgtggacaaccgcatcctggctaaacttaattttgcagactgggccaacgttgaagcccctgtcatcctgttccgcgcggaacgcatgcatgatggagctatcgaacttgaaccaaactatgccaagattgatcaagatggaggatggtccggaattgtcaacgatttggaaattgttcagctgaatggtgaccacctggcagttgtcgatgaaccagaaatcggcacagtcggagctcatttgagtcgccgcattgatgagatttctcggaagaattagtaacggagagctgacggaag

SEQ ID NO: 14 - protein, 1610 aa, Corynebacterium glutamicum
MEQSQSSDQKMTVEQVRTWLRDWVVRTTGIPVEEVTDDKAMETFGLSSRDVVVLSGELENLLDTSLDATIAYEYPTIRSLAQRLVEGEPRRAHTQRELNFSAVSDSPGSHDIAVVGMAARYPGAESLEDMWKLLVEGRDGISDLPIGRWSEYAGDEVMSRKMEEFSTIGGYLSDISSFDAEFFGLSPLEAANMDPQQRILLELTWEALEYARIAPNTLRGEAVGVFIGSSNNDYGMMIAADPAEAHPYALTGTSSAIVANRINYAFDFRGPSVNVDTACSSSLVAVHQAVRALRNGEADHAIAGGVNILASPFVTTAFAELGVISPTGKIHAFSDDADGFVRSDGAGVVVLKRVDDAIRDGDKIIGVIKGSAVNSDGHSNGLTAPNPDAQVDVLQRAYVDAQVDPTTVDYVEAHGTGTILGDPIEATALGAVLGYGRDASTPTLLGSAKSNFGHTESAAGIAGVIKVLLALQNKTLPPTVNFAGPNRYIDFDAERLEVVEDPREWPEYNGHAVAGVSAFGFGGTNAHVVISEYNAEDYETRAPKEALLPDQQVALPVSGHLPSRRRQAAADLADFLEGRKDCDLTPVARALAGRNHGRSRAVVLASTIEEAVKRLRQVAEGKVSVGISAADSPAANGPVFVYSGFGSQHRLMIKELCSISPQFRERIEELDEMVKFESGWSIMKLVLDDEQTYDTETAQVVITAIQIALTDLLASFGVKPAAVMGMSMGEIAAAYAAGGLSDRDTMLIASHRSRLMGEGEKSLAEDQLGAMAVVEFAAADLDKFIEENPEYKGIEPAVYAGPGMTTVGGPRDAVVQFVEKLESEDKFARLLNVKGAGHTSAVEPLLGELAGEIAGIEPLPLQIPLFSSVDQGVTYPVGAVVHDADYMLRCTRQSVYFQDSTEAAFAAGHNTLVEISPNPVALMGMMNTAFTVGKPDAQLLFSLKRKVPEAESLRDLLAKLYVNGANVDFSALYGEGETIDPPHITWKHQRFWTSARPSSGASLDLPGFRVNLPNNTVAFSTAAELAPSAVAIMEAAAMAVTPGSSVDAVDERDMLPPSGEITTIVTRSLGGLSLSVYKIEGTTSTLVAEGFAANPGFAAASSFDGPGYDGFNTDYSDQPDPRSDLPLDIEAVRWDPATETVEERMRAIVSEAMGYDVDDLPRELPLIDLGLDSLMGMRIKNRIENDFQIPPLQVQALRDASVADVVIMVENMVAGRSSETLVDATPQVPAEAAGEAQAAESSASGEDVQGVGVAPRDASERMVFGTWAGLTGAAAAGVTSKLPQIDVDTATAIAERLTERSGIEISTEQVLAAETLEPLSDLVREGLETEVQGNIRVLRGRAEGSTKPAVFMFHPAGGSSVVYQPLMRRLPEDVPVYGVERLEGDLADRAAAYVDDIKKYSDGFPVVLGGWSFGGAVAFEVAHQLVGSDVEVATVALLDTVQPSNPAPDTAEETRARWTRYADFAKKTYGLDFEVPFEILDTIGEDGMLSMMTDFLANTDASEHGLSAGVLEHQRASFVDNRILAKLNFADWANVEAPVILFRAERMHDGAIELEPNYAKIDQDGGWSGIVNDLEIVQLNGDHLAVVDEPEIGTVGAHLSRRIDEISRKN

SEQ ID NO: 15 - DNA, 540 bp, Corynebacterium glutamicum
  CDS (101)..(517): RXA01138
cttattcaagtttttggaaagataattaactatgactttaaaaacagtaaacggaacgcagctgcgagacactgtcggatcgttcccttcaggtgtcacggtggtcaccactaccgatggggaagtggaccacgggttgactgtgagtgcgttcgtgtccttgtcgttggagcctgccatggtgttggtgagtatcgataagaaatcaagcgttgtgccgtttttggagcagggttcaccagttgctgtgtctgtgttatcggaagagcagagcgatttggccatcacatttggccgtcatctggaaaacaaattcgacggcgtttccattaagcgttcaacaaacagggcagcggtcttggaaggtgcgtcagcatggttgagtggcgctgtggtggataaatacccaggtggagatcactttattatcaccattgccgtggaagagtgtgctcacgacgaggagcaaaagccacttctttaccaccgtggcaggctttttcagtggcaagaagattaattctccaccccttcattttc

SEQ ID NO: 16 - protein, 139 aa, Corynebacterium glutamicum
VVTTTDGEVDHGLTVSAFVSLSLEPAMVLVSIDKKSSVVPFLEQGSPVAVSVLSEEQSDLAITFGRHLENKFDGVSIKRSTNRAAVLEGASAWLSGAVVDKYPGGDHFIITIAVEECAHDEEQKPLLYHRGRLFQWQED

SEQ ID NO: 17 - DNA, 756 bp, Corynebacterium glutamicum
  CDS (101)..(733): RXA01980
aggatcgtaccaaataaggcaataaactctttttacttttcctcaacttcctgaaaagtcgccgccctagaattcactaagtttccgatatctttaacccatgcagatcattgatctctctcatgcgttcgcgcccggacaaccccactaccctggggatccagatcaagaaattaagacggtctccacgattgaaaacgatggctttttaatgcatcaatacagacttgttggtccctggggaacgcatgtagatgcacctgcacatttcgatccacaaggtcggacgcttgatcagatccctgtggaggaaacgcatttacccctttattgcctgaggttttctcgccccgatctatgtactgctgctgatatagaagcgtttgaacatacacacgggaaaatcgaaccaggatccttcgtcgcactccacactggatgggaatggggtaaacaagggatcgcacccggctggtctatcgaggctttagaaatcctccatgcccgtggagtcattgccattggccacgatcttcccgatacagatccttcactggaggcacagcgctggtggctgtgccgtgaccattggcagattgaaaacctcaccaatttggacaaggttcctgcaacgggtgcgatgattgcttgtccttggccagttccaaaagatggtgctagtttcccagtgcgtccaattgctctcgtcccagagcacctatcccctactcgctaaagcgaacggcagcaccttct

SEQ ID NO: 18 - protein, 211 aa, Corynebacterium glutamicum
MQIIDLSHAFAPGQPHYPGDPDQEIKTVSTIENDGFLMHQYRLVGPWGTHVDAPAHFDPQGRTLDQIPVEETHLPLYCLRFSRPDLCTAADIEAFEHTHGKIEPGSFVALHTGWEWGKQGIAPGWSIEALEILHARGVIAIGHDLPDTDPSLEAQRWWLCRDHWQIENLTNLDKVPATGAMIACPWPVPKDGASFPVRPIALVPEHLSPTR

SEQ ID NO: 19 - DNA, 1830 bp, Corynebacterium glutamicum
  CDS (101)..(1807): RXN01007
tctgaaccaatataccgatcagtctaaaagtgtgttaagttctggaacataaattagctgacacgtaaagtaacttaaagattcactggaggtaagcctagtgtttaaaaagcacagacacggtctcggctcccccgaaaccaaaccacgctcaataacccgccggtttttcaccgcggccgccgctacgctggcaggattggcagtcctgtccggctgcacagcacaaccctcacaagcagaagacaacacgctcacttacttagagccacagttcttccgcaccctgtacccaccatcagcgggcttttaccccaacggcagtgtggtgaacaacattgcagaccgcttgctctaccaggatcctgaaaccttggaactcaagccgtggatcgccaccgaactcccagaagtaaacgaagacgccacggaatttaccttcaacatccgcaccgatgtcacctactccgatggcaccccgctgacggctgaaaacgtggtgaaaaacttcgatctctatggcctcggcgatcaagatcgacgcctcaccatctctgagcagatcaccaactacgaccacggcgaagtagtagatgaggacaccgtccgattccacttctctgagcctgcacctggttttgctcaggccaccagctccttcaacgctggcctttatgccgattccaccttggagttcgccaatgaggatttcgcgccaggcaacgcccaaaacgtcatcggctccggtcctttcgtgatcaccgatgaaaccctaggcaccaacctcaccttgactgcgcgtgaggattacgattgggcaccaccatcacgcgaacatcaaggtcgcgcgaagcttgacgccgtcaattatgtcctcgcgggtgaagaatccgtccgcatcggagccatcgttgctggccaaggtgatatcgcccgccagatcgaagcgccagtggaggcacacctgaaggatgcaggcatcccgatcatctccgcagccaccaacggtgtgaacaacagcttcaacttccgcttcaaaaacgagctgctctcagacatccgtgttcgccaagctctgatccacgcgatcgaccgcgaaaagatcatgcgtgtgctgtttagtgattcctatccgctggcaacttctgtgcttgcgcaaaatgcactgggctacaaagaacaagtagatgcctatgtctacgacctagacaaagcaacagctctgcttgacgaagccggctggacccttgatagcgacggcatgcgtcgcaaggacggtgaacttctagagctcaccttcaacgaagccctcccacagcctcgttcacgcgaagttgtcaccatggtccaagaacagctcggtgatctgggcatcaaggtcaacctcaacccaggtgaccaagcagcccaggacgctgactccaaggatctcaacaagatccaggttcgccacaccatggtgggtcgcgcagactatgacgtgctgaaatcccagctgtactccaccaaccgcaacgagctgttgaacatgaccgtggaaggggagaccgccgatattggcgatcctcatttggaggaactcctcatggctattgcatccagcccacgcgaagaggaccgtgcagcagcatctgccgcagcacaggattacatcaccgagcaggcatatgttcttccactgtttgaagagccagttgtctacggcgtgcagccttacgtgaagggctttagccccgaagtgatcggccgccccagcttctatgagacctacattgaccattccagcgaccattccagtgaggaggactaaatgactacctcgcagattct

SEQ ID NO: 20 - protein, 569 aa, Corynebacterium glutamicum
VFKKHRHGLGSPETKPRSITRRFFTAAAATLAGLAVLSGCTAQPSQAEDNTLTYLEPQFFRTLYPPSAGFYPNGSVVNNIADRLLYQDPETLELKPWIATELPEVNEDATEFTFNIRTDVTYSDGTPLTAENVVKNFDLYGLGDQDRRLTISEQITNYDHGEVVDEDTVRFHFSEPAPGFAQATSSFNAGLYADSTLEFANEDFAPGNAQNVIGSGPFVITDETLGTNLTLTAREDYDWAPPSREHQGRAKLDAVNYVLAGEESVRIGAIVAGQGDIARQIEAPVEAHLKDAGIPIISAATNGVNNSFNFRFKNELLSDIRVRQALIHAIDREKIMRVLFSDSYPLATSVLAQNALGYKEQVDAYVYDLDKATALLDEAGWTLDSDGMRRKDGELLELTFNEALPQPRSREVVTMVQEQLGDLGIKVNLNPGDQAAQDADSKDLNKIQVRHTMVGRADYDVLKSQLYSTNRNELLNMTVEGETADIGDPHLEELLMAIASSPREEDRAAASAAAQDYITEQAYVLPLFEEPVVYGVQPYVKGFSPEVIGRPSFYETYIDHSSDHSSEED

SEQ ID NO: 21 - DNA, 858 bp, Corynebacterium glutamicum
  CDS (101)..(835): RXN00784
gtcacatcagttatcgcgcggaatagttagcgggcgcatgtggttgggatatatgaataaatctattccaactacgcgtaaaacgaggacgtttaaagctatgtctattgaattctccgcaccagcaaaaatgaaaatcgaagtgtggagcgacatcatgtgccccttctgctacatcggcaaaaagcgcctcgacgacgccctaagtacctttgaccaggccggacgcatcgaagtggaatacaagagcttcgaactcatgccaggcctagaaacccacccactgcgttccgacgttgaatacctcgccgacgccaagggcatgagcctcgagcaggcccgccaaatgaacggccaagtccaagcaatggcacaagccaccggacttgaaatgaatcctgacgaaaccatcgcggccaacaccatcaacgcgcaccgccttacccacttcgcgaaagcccacggcaagcaacaagaagtggcgcaggaactcttcaaggctcacttcgtagacggcaagaacgttgatgacctcgatgtgctggtctccattgctgcagaggttggtctcgatgccagtgcagcccgcgaagctctcgaatccgacgtgtacaccaacgaagtccaacaagacgtccacgaagcccgccaactcggcgtccaaggtgtgcccttctttgtattcgaccgcaaatacgccatcaacggcgcccaacaagaagaagtattcaccggcaccgtagaaaaagccttcgaagagtgggcagccgaaaacccagtcagcccatttgaggtcattgacggccaaagctgctccgtcgacggcacctgcaactaacttttgggacctatgtgcgt

SEQ ID NO: 22 - protein, 245 aa, Corynebacterium glutamicum
MSIEFSAPAKMKIEVWSDIMCPFCYIGKKRLDDALSTFDQAGRIEVEYKSFELMPGLETHPLRSDVEYLADAKGMSLEQARQMNGQVQAMAQATGLEMNPDETIAANTINAHRLTHFAKAHGKQQEVAQELFKAHFVDGKNVDDLDVLVSIAAEVGLDASAAREALESDVYTNEVQQDVHEARQLGVQGVPFFVFDRKYAINGAQQEEVFTGTVEKAFEEWAAENPVSPFEVIDGQSCSVDGTCN

SEQ ID NO: 23 - DNA, 1896 bp, Corynebacterium glutamicum
  CDS (101)..(1873): RXA02335
tggttgagttcttcggggttgagtgtgcaagaatattcactattggtcaggcaactatgtgtctacccactgagtcatcaatttaaatcaggagttattagtgtcagtcgagactaggaagatcaccaaggttcttgtcgctaaccgtggtgagattgcaatccgcgtgttccgtgcagctcgagatgaaggcatgggatctgtcgccgtctacgcagagccagatgcagatgcaccattcgtgtcatatgcagacgaggcttttgccctcggtggccaaacatccgctgagtcctaccttgtcattgacaagatcatcgatgcggcccgcaagtccggcgccgacgccatccaccccggctacggcttcctcgcagaaaacgctgacttcgcagaagcagtcatcaacgaaggcctgatctggattggaccttcacctgagtccatccgctccctcggcgacaaggtcaccgctcgccacatcgcagataccgccaaggctccaatggctcctggcaccaaggaaccagtaaaagacgcagcagaagttgtggctttcgctgaagaattcggtctcccaatcgccatcaaggcagctttcggtggcggcggacgtggcatgaaggttgcctacaagatggaagaagtcgctgacctcttcgagtccgcaacccgtgaagcaaccgcagcgttcggccgcggcgagtgcttcgtggagcgctacctggacaaggcacgccacgttgaggctcaggtcatcgccgataagcacggcaacgttgttgtcgccggaacccgtgactgctccctgcagcgccgtttccagaagctcgtcgaagaagcaccagcaccattcctcaccgatgaccagcgcgagcgtctccactcctccgcgaaggctatctgtaaggaagctggctactacggtgcaggcaccgttgagtacctcgttggctccgacggcctgatctccttcctcgaggtcaacacccgcctccaggtggaacacccagtcaccgaagagaccaccggcatcgacctggtccgcgaaatgttccgcatcgcagaaggccacgagctctccatcaaggaagatccagctccacgcggccacgcattcgagttccgcatcaacggcgaagacgctggctccaacttcatgcctgcaccaggcaagatcaccagctaccgcgagccacagggcccaggcgtccgcatggactccggtgtcgttgaaggttccgaaatctccggacagttcgactccatgctggcaaagctgatcgtttggggcgacacccgcgagcaggctctccagcgctcccgccgtgcacttgcagagtacgttgtcgagggcatgccaaccgttatcccattccaccagcacatcgtggaaaacccagcattcgtgggcaacgacgaaggcttcgagatctacaccaagtggatcgaagaggtttgggataacccaatcgcaccttacgttgacgcttccgagctcgacgaagatgaggacaagaccccagcacagaaggttgttgtggagatcaacggccgtcgcgttgaggttgcactcccaggcgatctggcactcggtggcaccgctggtcctaagaagaaggccaagaagcgtcgcgcaggtggtgcaaaggctggcgtatccggcgatgcagtggcagctccaatgcagggcactgtcatcaaggtcaacgtcgaagaaggcgctgaagtcaacgaaggcgacaccgttgttgtcctcgaggctatgaagatggaaaaccctgtgaaggctcataagtccggaaccgtaaccggccttactgtcgctgcaggcgagggtgtcaacaagggcgttgttctcctcgagatcaagtaagttcttggattcctgttagt

SEQ ID NO: 24 - protein, 591 aa, Corynebacterium glutamicum
VSVETRKITKVLVANRGEIAIRVFRAARDEGMGSVAVYAEPDADAPFVSYADEAFALGGQTSAESYLVIDKIIDAARKSGADAIHPGYGFLAENADFAEAVINEGLIWIGPSPESIRSLGDKVTARHIADTAKAPMAPGTKEPVKDAAEVVAFAEEFGLPIAIKAAFGGGGRGMKVAYKMEEVADLFESATREATAAFGRGECFVERYLDKARHVEAQVIADKHGNVVVAGTRDCSLQRRFQKLVEEAPAPFLTDDQRERLHSSAKAICKEAGYYGAGTVEYLVGSDGLISFLEVNTRLQVEHPVTEETTGIDLVREMFRIAEGHELSIKEDPAPRGHAFEFRINGEDAGSNFMPAPGKITSYREPQGPGVRMDSGVVEGSEISGQFDSMLAKLIVWGDTREQALQRSRRALAEYVVEGMPTVIPFHQHIVENPAFVGNDEGFEIYTKWIEEVWDNPIAPYVDASELDEDEDKTPAQKVVVEINGRRVEVALPGDLALGGTAGPKKKAKKRRAGGAKAGVSGDAVAAPMQGTVIKVNVEEGAEVNEGDTVVVLEAMKMENPVKAHKSGTVTGLTVAAGEGVNKGVVLLEIK

SEQ ID NO: 25 - DNA, 1575 bp, Corynebacterium glutamicum
  CDS (101)..(1552): RXA02173
ctaaattgggcttagatcttccgcctctaaataggtatgcagagacattcgaattaattaacaaagccatttttcggccgtggagaagcgttttccgactatggtgtggggcatggaacacacttcagcattgacgctcatagactcggttttggaccctgacagcttcatttcttggaatgaaactccccaatatgacaacctcaatcaaggctatgcagagaccttggagcgggctcgaagcaaggccaaatgcgatgaatcggtaattactggagaaggcaccgtggagggcattccggtagccgttattttgtccgatttttccttcctcggcggttctttgggcacggtcgcgtcggtgcgcatcatgaaggcgattcaccgcgccacagagctgaaactcccactgctggtctcccctgcttccggtggtgcgcgcatgcaggaagacaatcgagcttttgtcatgatggtgtccataaccgcggctgtgcagcgtcaccgcgaggcgcatttgccgttcctggtgtatttgcgcaatcccacgatgggtggcgccatggcctcgtggggttcatctgggcatctcacttttgcggaacccggcgcgcagataggtttcctgggtcctcgcgtggtggagttaaccactgggcatgcgcttccagacggtgtgcagcaggcggagaatttggtgaaaactggtgtgattgatggaattgtgtcgccactccaattgcgtgcagcggtggcaaaaaccctcaaggttattcagccggtagaggcaacggatcgtttttctccaacaactcctggcgtggcacttccggtgatggaggcgattgcgcgttctcgtgacccgcagaggcctggaatcggggagattatggaaacgttgggggcagacgtcgtcaagctttctggtgcgcgtgctggcgcattgagcccggctgtgcgcgttgccctggcgcgcatcgggggccggcccgtggtgctgattgggcaggatcgccgcttcacgcttgggccgcaggagctgcgttttgcgcgtcgtggcatttcgctggcgcgcgagctaaacctgccgatcgtgtccatcatcgacacctccggcgccgaattgtcgcaggcggctgaggagctcggcatcgcaagctcgattgcgcgcaccttgtccaagcttatcgacgctcccctccccaccgtttcggtcattattggtcagggcgttggcggtggcgcgctggccatgctgcccgccgatctggtctacgcggccgaaaacgcgtggctgtccgcattgccaccagagggcgcctcggccatcctcttccgcgacaccaaccacgccgcggaaatcatagagcgacaaggcgtgcaggcgcacgcacttttaagccaagggcttatcgacgggatcgtcgccgaaaccgagcactttgttgaagaaattctcggcacaatcagcaacgccctctccgaattggataacaatccggagagggcgggacgcgacagtcgcttcacacgatttgagcgtttagcgcagtaaagaaaattatgcgctgatca

SEQ ID NO: 26 - protein, 484 aa, Corynebacterium glutamicum
MVWGMEHTSALTLIDSVLDPDSFISWNETPQYDNLNQGYAETLERARSKAKCDESVITGEGTVEGIPVAVILSDFSFLGGSLGTVASVRIMKAIHRATELKLPLLVSPASGGARMQEDNRAFVMMVSITAAVQRHREAHLPFLVYLRNPTMGGAMASWGSSGHLTFAEPGAQIGFLGPRVVELTTGHALPDGVQQAENLVKTGVIDGIVSPLQLRAAVAKTLKVIQPVEATDRFSPTTPGVALPVMEAIARSRDPQRPGIGEIMETLGADVVKLSGARAGALSPAVRVALARIGGRPVVLIGQDRRFTLGPQELRFARRGISLARELNLPIVSIIDTSGAELSQAAEELGIASSIARTLSKLIDAPLPTVSVIIGQGVGGGALAMLPADLVYAAENAWLSALPPEGASAILFRDTNHAAEIIERQGVQAHALLSQGLIDGIVAETEHFVEEILGTISNALSELDNNPERAGRDSRFTRFERLAQ

SEQ ID NO: 27 - DNA, 1056 bp, Corynebacterium glutamicum
  CDS (101)..(1033): RXA01764
ttttcaaaattaatagttgacattttcaacgttatgagttttcattggtatcacgccccgacgaagtgtctgggatcacaaaccttcaaaggagtttgaaatgtctctcaatggaaaagtcgccatcgttaccggatctggtgcaggacttggtcgttccttcgctcaggagcttgcccgtcagggtgcatctgtcatcgtcaatgacgtaaaccaggcagccgcagatgagactgtcgcagcaatcaccgaagccggcggcaaagccgccgccgttatcgcccccgttggaccctctgaaagcgccgcattgctggtgcgggaggccgtcgacaagttcggttctttggacattcttgtcacaaacgcgggcatccttcgtgataggtccctgctgaagatgacggacgatgatttcgatgcagtcattaacgtgcacctcaagggcactttcacctgtgttcgcgaggcatttggatacttcaaggagaatggaatcgcggggcgcatcgtcacgattggttctcccaccgggcagcgcggcaacttcggacagagcaattacgctgcagctaaggcgggcattgtgggtatggttcgcacgtgggcgctggagatgaagcgcgcaggtgtcaccattaacgcgatcattccggaagcagccaccgatatgaccaagacggtgccatatttccagaaggctgtagaggccgatgagcgtggcgaggccatgccagcattcttccgcgagaccctaggttttggcactcctcaggatgttgcgggacttgtggccttcctttcctctgatgaggcagcgaatatttctggacaggccatcggtgcaggcggcgaccgcatgcaggtgtggaagcacccagagccagcagttactgaatttaacccaggtggctggacctatgaagcactgcaggaacgtggcaagaacattattgagggcaacctgcagtccgtcggtgtcgttttccctgaactgccggcagagcttcagccacaaatcccagtcaaggcataacaccgcacaccaagaatttt

SEQ ID NO: 28 - protein, 311 aa, Corynebacterium glutamicum
MSLNGKVAIVTGSGAGLGRSFAQELARQGASVIVNDVNQAAADETVAAITEAGGKAAAVIAPVGPSESAALLVREAVDKFGSLDILVTNAGILRDRSLLKMTDDDFDAVINVHLKGTFTCVREAFGYFKENGIAGRIVTIGSPTGQRGNFGQSNYAAAKAGIVGMVRTWALEMKRAGVTINAIIPEAATDMTKTVPYFQKAVEADERGEAMPAFFRETLGFGTPQDVAGLVAFLSSDEAANISGQAIGAGGDRMQVWKHPEPAVTEFNPGGWTYEALQERGKNIIEGNLQSVGVVFPELPAELQPQIPVKA

SEQ ID NO: 29 - DNA, 1827 bp, Corynebacterium glutamicum
  CDS (101)..(1804): RXN02487
tcatagctacgcgcatgcccacattctagatcgccgaagaaagcagcgggacgtctctatatactaaagggcactaaagcaacgcagttgaagggacaccatgtcagcatacgaaaccaaagaatggctccagcactacccagagtggacgccacactcgctggaatatggcgacaccaccctgctggacgtttacgacaacaacctggccattaacgcagacaagccagccacctactttttcggtcgttcacaaacctacggtgaactggacaaagaagtccgcaaaactgccgctggcctgcgcgcactaggtgtccgccccggcgatcacgtagcgattatcctccccaactgcccacagcacatcgcagctttctacgcagtgctgaaactcggcgcagtagtcattgagcacaacccgctctacaccgcccacgaactgctcgaacccttcaaagaccacggtgcccgcgttgccatcgtctgggacaaagcctcccccaccgtcgaacagctacgtggacagacccagttggaaaccatcgtgtcggtcaacatgatcaacgcgatgccaccactccagcgcctagcacttcggctcccaatccctgcactgcgcaagagccgcgaatccctctccggcgcagcccccaacaccgttccttttgaaaccctgaccagcgcagcaatgggcggcgacggcgacgacgtagtttcagaacccaccgtgaccaaagaatccgtcgcgctgatcctctacacctccggcaccaccggacgccccaagggtgcccagctcacccacggaaacctgttcttcaatcttcttcaaggaaagcactgggttccaggtctcggagacaaaccagaacgcatgcttgcagccctaccaatgttccacgcatacggtctgaccatggtcggcacactgtccgtgttcatcggtggcgaaatggtgctacttcccaccccacgcatcgacctgatcatgaacgtaatgaaaaagcacaccccaacctggctaccaggcgtgcccaccctttacgaaaaaatcgtcgacgcctccgaaaaagaaggaatccccatcaagggagtccgcaacgccttctccggtgcatccacactctcccagcgcaccgttgaacgctgggaaaagcacaccggcggacgcctcgtcgaaggctacggcctcaccgaaacctcccccatcatcgtgggtaaccccatgagcgatcaccgacgccaaggctacgtaggaatccccttccccgacaccatcgtgcgcatcgcaaacccagaaaacctcgacgaaaccatgcccgacggcagcgaaggcgaagtcctagtcaagggcccacaggtgttcaagggttacctcaaccaggaagaagccaccaagaacagcttccacggcgagtggtaccgcaccggcgacgtcggagtgatggaagaagacgggttcatccgcctagttgctcgcatcaaggaagtcatcatcactggcggtttcaacgtgtacccagctgaggttgaagaagtcctcgcagagcacccagacattgaagattccgcagtcgttggtatcccgcgtgaagacggctccgaaaacgtcgttgctgccatcactttggtggaaggtgcagcgctggatccggatggcctgaaggaattcgcccgcaagaacctcacccgctacaaggttccgcgcactttctaccactttgaggagatgccgcgggatcagatgggcaagattaggcgtcgtgaagtgcaggcggagttgttgaagaagctcggcaagtagacgccgatttaagaggtcga

SEQ ID NO: 30 - protein, 568 aa, Corynebacterium glutamicum
MSAYETKEWLQHYPEWTPHSLEYGDTTLLDVYDNNLAINADKPATYFFGRSQTYGELDKEVRKTAAGLRALGVRPGDHVAIILPNCPQHIAAFYAVLKLGAVVIEHNPLYTAHELLEPFKDHGARVAIVWDKASPTVEQLRGQTQLETIVSVNMINAMPPLQRLALRLPIPALRKSRESLSGAAPNTVPFETLTSAAMGGDGDDVVSEPTVTKESVALILYTSGTTGRPKGAQLTHGNLFFNLLQGKHWVPGLGDKPERMLAALPMFHAYGLTMVGTLSVFIGGEMVLLPTPRIDLIMNVMKKHTPTWLPGVPTLYEKIVDASEKEGIPIKGVRNAFSGASTLSQRTVERWEKHTGGRLVEGYGLTETSPIIVGNPMSDHRRQGYVGIPFPDTIVRIANPENLDETMPDGSEGEVLVKGPQVFKGYLNQEEATKNSFHGEWYRTGDVGVMEEDGFIRLVARIKEVIITGGFNVYPAEVEEVLAEHPDIEDSAVVGIPREDGSENVVAAITLVEGAALDPDGLKEFARKNLTRYKVPRTFYHFEEMPRDQMGKIRRREVQAELLKKLGK

SEQ ID NO: 31 - DNA, 411 bp, Corynebacterium glutamicum
  CDS (101)..(388): FRXA02487
ggcgagtggtaccgcaccgcgacgtcggagtgatgaagaagccgggttcatccgcctagttgctcgcatcaagaaagtcatcatcactggcggtttcaacgtgtacccagctgaggttgaagaagtcctcgcagagcacccagacattgaagattccgcagtcgttggtatcccgcgtgaagacggctccgaaaacgtcgttgctgccatcactttggtggaaggtgcagcgctggatccggatggcctgaaggaattcgcccgcaagaacctcacccgctacaaggttccgcgcactttctaccactttgaggagatgccgcgggatcagatgggcaagattaggcgtcgtgaagtgcaggcggagttgttgaagaagctcggcaagtagacgccgatttaagaggtcga

SEQ ID NO: 32 - protein, 96 aa, Corynebacterium glutamicum
VYPAEVEEVLAEHPDIEDSAVVGIPREDGSENVVAAITLVEGAALDPDGLKEFARKNLTRYKVPRTFYHFEEMPRDQMGKIRRREVQAELLKKLGK

SEQ ID NO: 33 - DNA, 913 bp, Corynebacterium glutamicum
  CDS (101)..(913): FRXA02490
tcatagctacgcgcatgcccacattctagatcgccgaagaaagcagcgggacgtctctatatactaaagggcactaaagcaacgcagttgaagggacaccatgtcagcatacgaaaccaaagaatggctccagcactacccagagtggacgccacactcgctggaatatggcgacaccaccctgctggacgtttacgacaacaacctggccattaacgcagacaagccagccacctactttttcggtcgttcacaaacctacggtgaactggacaaagaagtccgcaaaactgccgctggcctgcgcgcactaggtgtccgccccggcgatcacgtagcgattatcctccccaactgcccacagcacatcgcagctttctacgcagtgctgaaactcggcgcagtagtcattgagcacaacccgctctacaccgcccacgaactgctcgaacccttcaaagaccacggtgcccgcgttgccatcgtctgggacaaagcctcccccaccgtcgaacagctacgtggacagacccagttggaaaccatcgtgtcggtcaacatgatcaacgcgatgccaccactccagcgcctagcacttcggctcccaatccctgcactgcgcaagagccgcgaatccctctccggcgcagcccccaacaccgttccttttgaaaccctgaccagcgcagcaatgggcggcgacggcgacgacgtagtttcagaacccaccgtgaccaaagaatccgtcgcgctgatcctctacacctccggcaccaccggacgccccaagggtgcccagctcacccacggaaacctgttctccaatctcctccaaggaaagcactgggttccaggtctcggagacaaaccagaacgcatgcttgcagccctaccaatgttccacgcatacggt

SEQ ID NO: 34 - protein, 271 aa, Corynebacterium glutamicum
MSAYETKEWLQHYPEWTPHSLEYGDTTLLDVYDNNLAINADKPATYFFGRSQTYGELDKEVRKTAAGLRALGVRPGDHVAIILPNCPQHIAAFYAVLKLGAVVIEHNPLYTAHELLEPFKDHGARVAIVWDKASPTVEQLRGQTQLETIVSVNMINAMPPLQRLALRLPIPALRKSRESLSGAAPNTVPFETLTSAAMGGDGDDVVSEPTVTKESVALILYTSGTTGRPKGAQLTHGNLFSNLLQGKHWVPGLGDKPERMLAALPMFHAYG

SEQ ID NO: 35 - DNA, 414 bp, Corynebacterium glutamicum
  CDS (101)..(391): RXA01467
gcgtcatctttagccttgctttatgagcttttccccgcaatgagccgcgttgtgtatccataagtcttagcctacaagcgctttgaggtagtttgggatcatggatttcaacgacaaagccgcttcagaaaacgctgtaaagactggcgcagaaggccccaacgttttcgcgagcgtggccaagattttgcaggatgttggcggaatttcagccgaagacgtcactccggaatctcgttttactgaggatttggcagtgagctcactcaattacatcgagttgattgtcaatgcggaggacgcatttggtgttcgcattgaggacgccgatgccaaggatttgaccaccgtgcaggatttgattgactttattaacaccaataaggctgattagcgggaaaatttcgcccaaaa

SEQ ID NO: 36 - protein, 97 aa, Corynebacterium glutamicum
MDFNDKAASENAVKTGAEGPNVFASVAKILQDVGGISAEDVTPESRFTEDLAVSSLNYIELIVNAEDAFGVRIEDADAKDLTTVQDLIDFINTNKAD

SEQ ID NO: 37 - DNA, 298 bp, Corynebacterium glutamicum
  CDS (101)..(298): RXA00796
ctggaatcccaaagcgcttgcatgacgcggaaagttaacataggctaggtacgtcaagttgttgatacatcaacttaattaacttttagaggagtacaccatgagcaagatcgccatcatcaccggttccacccgtccaggccgcgtcaacattgacgtagccaactgggttctcgagcgcgcacaagagcgcaacgatgcacagtacgagctcgttgatatcgccgatttcaacttccccgtcctcgacgaagcaatgccagccggctacggccagtatgcaaacgagcacaccaag

SEQ ID NO: 38 - protein, 66 aa, Corynebacterium glutamicum
MSKIAIITGSTRPGRVNIDVANWVLERAQERNDAQYELVDIADFNFPVLDEAMPAGYGQYANEHTK

SEQ ID NO: 39 - DNA, 666 bp, Corynebacterium glutamicum
  CDS (101)..(643): RXA01897
ctatttagatcgttccggaaccgatccacgcgccgatatccactccctggatgaactctttcactaggctggcctttattgtttccggaaaggggttgctatgaaaattggtgtcatcctgggcagtatccgcgaaggccgcttcggccaaggcgttgccgattgggtcatggaacaaatcggggcttatgacgcacccgatgtggaatttgaactcatcgacctcaaagctttcaacgtgcccctgttggaatccgcgacagttccaggttccgcggataaacagtacgacgacccgcgcgtaactgcctggtcacaggccattgatgcctgcgatgccttccttttcatcaccccggaatacaaccacggtgtgcccggcgcgttcaaaaatgcgtatgacatcctgggcaatgaatggctgaacaaaaccgtcggtttcatttcctacggtgcagtcgaagggatccgtgttgtcgaacagtggcgtcagatcgtcgccaccttcaacatgtacgatatccgcagccagctatccttttccaccttcaccgagaacaacaacggcacttttgcgcccaatgatcgacgccccggtgaactaatccgcctccttgatagcctcctaacggctgtccgcgattaaggctctgaaatactaatgag

SEQ ID NO: 40 - protein, 181 aa, Corynebacterium glutamicum
MKIGVILGSIREGRFGQGVADWVMEQIGAYDAPDVEFELIDLKAFNVPLLESATVPGSADKQYDDPRVTAWSQAIDACDAFLFITPEYNHGVPGAFKNAYDILGNEWLNKTVGFISYGAVEGIRVVEQWRQIVATFNMYDIRSQLSFSTFTENNNGTFAPNDRRPGELIRLLDSLLTAVRD

SEQ ID NO: 41 - DNA, 375 bp, Corynebacterium glutamicum
  CDS (1)..(375): RXN02809
aacctctccgtcccagcagcactaaccaacgccctttcctacctctccgcagagtggaacaacaaggctgcaggcatcgtctcctacggctccgcaatgggcgttcgcgcagctgagcacctccgcggcatcctttccgagcttcagatcgcacacgttcaaaagaccggcctgctgagcatcttcaccgacttcgaataccctaacttcaagccttccgagcagggcatctcctctgtggacgctatgcttgagcagcttgttgtctggaccaaggcaatgtccaccattcgcgagtctgcgaacgtctatcacttaagaacccctcacaaaagtggcgagctccccgactgggactcgcctcttttcgtattc

SEQ ID NO: 42 - protein, 125 aa, Corynebacterium glutamicum
NLSVPAALTNALSYLSAEWNNKAAGIVSYGSAMGVRAAEHLRGILSELQIAHVQKTGLLSIFTDFEYPNFKPSEQGISSVDAMLEQLVVWTKAMSTIRESANVYHLRTPHKSGELPDWDSPLFVF

SEQ ID NO: 43 - DNA, 273 bp, Corynebacterium glutamicum
  CDS (1)..(273): FRXA02809
gcagcactaaccaacgccctttcctacctctccgcagagtggaacaacaaggctgcaggcatcgtctcctacggctccgcaatgggcgttcgcgcagctgagcacctccgcggcatcctttccgagcttcagatcgcacacgttcaaaagaccggcctgctgagcatcttcaccgacttcgaataccctaacttcaagccttccgagcagggcatctcctctgtggacgctatgcttgagcagcttgttgtctggaccaaggcaatgtccacc

SEQ ID NO: 44 - protein, 91 aa, Corynebacterium glutamicum
AALTNALSYLSAEWNNKAAGIVSYGSAMGVRAAEHLRGILSELQIAHVQKTGLLSIFTDFEYPNFKPSEQGISSVDAMLEQLVVWTKAMST

SEQ ID NO: 45 - DNA, 5745 bp, Corynebacterium glutamicum
  CDS (101)..(5722): RXN00113
tctgcgcatcccactcgaggagctggcaaacggccgcaccatcgatgttgaggcacgcaccgactccatcgaagagtccgcatccggccgtatcgttaccgtgcgcatcgtgctcaccaccgaaggcgaagtagcagccaagctggttacccgcttcgcaattcgtggacgcatcaccaccaacgaaatggctgcaccagcagattcctacggcgcacgcgacgaagttgtcgaggcaacccctcgttccttcatccgccaggcaactgtttctgcacctgcagacatgaccccattcgccatggtttctggtgactacaacccaattcacacctctgacaacgctgcaaagcttgttggcctggacgcagctcttgtccacggcatgtggctgtccgctaccgcacagcacctcgctggtcttggctctgaggtcattggttggacctactccatgtacggcatggttcaactcaacgacgttgttgacatcaccgtcgagcgtgttggccgcgcaggtctgaagcctgcatacgaggtcacctgccgcattgatggcaacgttgtctcccgcggacaggcactgctcaaggctccttccaccgcttatgtttacccaagccagggcatccaggctaagggcatgggccaaggcgatcgcaccgcaagcgcagaggctcgcgctgtgtgggagcgtgcagatgcacacacccgcgcaaacctgggcttctccatccagcaggtcattgatgaaaacccaactgagctgaaggtcggggacaccaccttcgtgcacccagctggggttttgaacctcacccagttcacgcaggtcgcgctcgccgtggttgcctacgctcagaccgagcgcctcaaggctgcaaacgcaattgtcgacggctccctctacgcaggccactccctcggcgagtacaccgcactggcatccttgggcaacatcttcgaactcgaaggcgtcatcgacgttgtgttctcccgcggttccgcaatgcactccctggttccacgtgatgagaagggccgttccaactacggtcttgccgcattccgtccgaacatgatcaacgttgcagccaccgaggtggagaactgggttgaccgtgtcgctgaagaatccggcgaattcctgcagatcgttaactacaacgttgatggccagcagtacgcagtcgcaggtaccttggctggcctgaaggccctcaaggcttctgcatctgcaaacccacgtgcttacgtgaacattccaggcattgacgtgccattccactccagcgtcctgcgcccaggcgttcctgctttcgcagagaagctggacgagctgctgccagagaccatcgacattgatgctcttcgcggccgctacatcccgaacctggttgctcgtcctttcgagctcacccagagcttcgtggatgccatccttgctgttgttccatccgagcgcctcaagggcatcaaggtggaggacaccgacgagaacaccctggcacgtctgctcctcatcgagctgctgtcttggcagttcgcatcccctgtgcgttggatcgaaacccaggctctgatcatcgataccgtcgatcagatcatcgaggtcggcttggcagcatcgccaaccctgaccaacctggcactgcgcaccatggatgtcattggcaagtcccgcccagtattcaacgtggagcgcgaccaggacaccgttatgctcaacgatgttcgccaggcacctgttgctgaggttgaagaagaagcagttgaggaagcacctgcagcagccgcagctccagcagctgaggcaccagttgctgcagctccagtagccgcagccgcacctgcacctgttggaaacgcacctgaactgaagttcaacgctgccaatgccatcatggttctcttcgctgtccagaacaagatcaacattgatcagatcaccgcagcggatacctctgagaccctgaccaacggtgtgtcctcacgccgtaaccagatgctcatggacatgtccaccgagctgtccgtcccaaccatcgacggcgcagctgacgctgacgtagctaccctgcagggacgtgttgtcaccgcagctcctggctacaagcctttcggaccagttctttccgagaccgttcgtgcacgtcttcgcgcactgaccggtgcagcaggtctgaagacctcctacatcggcgatcgcgtgaccggcacctggggacttccagaaagctggaccgcacacgttgaggttgaattgctgctgggcacccgcgaaggcgagtccgtccgcggcggcaacctgggtagcctgcctgctaacgcatccagcaagggcgacgtcgatgcgcttatcgacgcagccgtgcagaatgttgctgcagccaacggcaccagcgtctccatgtcctccggcggtgcagcttcaggtggcggagttgttgattccgcagcacttgatgcctacgcatccaccgtcactggtgaagaaggcgtcctggcaaacgttgctcgcggcatcctgtctcagcttggtctcgacaccaaggacgaggttgaaggcgcagagatcgacaccgaactctacgacgctgtcgaagcagaactgggcaccggctggctgaagcttgtcaccccagtgttctccgctgatcgtgcgatcttgttcgacgaccgttgggcatctgcacgtgaagatctggcacgccttgccaacggcgaggatattgccgtcgagcgctttgctggaacgggggagaccgtcgtcaagcaagctgcatggtgggctgagcacgttgaagacaccgctctcgctgcaaccctgaagcaggtttccgaggtggctgcgaagccagccaacgagccacacatcgacgatgttgcgctggttaccggtgcggctcctgagtcgatcgccggtgcagttgcggctcgcctgctgtcccagggcgcgaccgtcattctcaccgcatcgaacgtctcccaggcgcgtaaggaatacgcacgcaagctctacgctgcgaacgcaacccctaacgcaaagctgtggattgttcctgcgaacatgtcctcctaccgcgatgttgatgcagtcatcgattggatcggcaacgagcagcgcgtcaccgtcggcagcaccgtcaccgtgaccaagccagctctgaccccaacccttgcgtacccattcgcagctccatccgtatccggtaccttggcggatgcaggcccacaggctgaaaaccaggcacgcctgctcctctggtccgtggagcgcaccatcgcaggacttgcagatcttgcatcccgcggtgtcgatggacgcgtccacgttgtactcccaggttccccgaaccgcggaatgttcggtggcgacggcgcttacggcgaagtcaaggctgctttcgacgccatccttgccaagtggggctccgagaccggctggccacagtttgtctccctcgcacaggcacgcatcggctgggtcgcaggcaccggcctcatgggtcgcaacgacgtgctcatccctgccgctgaaaagctgggcatccacgtctacacccctgaagagatctcttccgaactgctgggtcttgcatccgcagaatcccgcgaaaaggctctggaagcaccgatcgattacgacctgaccggtggactttccggtggcgtatccatcgcagcactggcagcatccctcgagtccgacgcagtagagaccacctctgcagcagaagacaccatcaaggcgcttccatcacctaagcacccagagcagccagtgggcacgccagttggagaggtcaagaccgatctcgaagacatggttgtcatggttggcgttggcgaagtctcctcatggggctccggacgtacccgcttcgaagctgagtacggcatccagcgcgacggctccgttgacctcaccgcagcaggcgtccttgagcttgcatggatgatgggtctgatctcctggagcgaagatccaaagccagcctggtacgacgctgacggcaccgaagtgcctgaagaagagatctacgagcgcttccgcgacgaagtcatcgcacgatgcggtgttcgtgagcttgtcgacgacgcattcctcgtcgacggcggctccctcgacgcagctgaagtcttcctcgaccgcgacatctccttctccgtaacctctgctgaagaagcacaggcctacgtcgatgcagatgcttccgtgaccgttgaagaagcagacggcgaatggatcgtgaccaagaagaagggctccacctccttcgtgccacgcaaggcaaccctgacccgctccgtagcaggccagctgccaaccgacttcgaccctgccaagtggggtatcccagcctccatgatcgatgcactcgacaacatcgcagcgtggaacctggtcactgcagtcgacgccttcctgtcctccggcttcagcccagcagaactcctgcagtccatccacccagctgacgtgtcctccacccagggcaccggtatcggtggcatgcagtccctacgcaagctgttcgtcaaccgcttcctcggccaggatcgtccatccgacatcctccaggagaccctgccaaacgttgtggctgcacacaccatgcagtcctacgtcggtggctacggccagatgatccacccagtggcagcatgtgcaaccgcagctgtctccgtggaagaaggcgtggacaagatccgcctcaacaaggcagatttcgttgtcgccggtggtatcgatgacatccaggttgaatccctgaccggcttcggtgacatgaacgccaccgcagacacccaggcaatgctggacaagggcatcgacccacgcttcatctcccgcgcaaacgatcgacgtcgcgcaggcttcctcgaagcagcaggtggcggtaccgtcctcctggcacgtgcatccgttgctgctgaactgggactgccagttctcgcagttgttgcacacgcacagtcctacgccgatggtgctcacacctccatcccagcaccgggacttggcgcactgggtgcagcacgtggtggcaagaagtccgtacttgctcgcgaactgaacaaattgggtctgaccccagatgacgttcgcgtggtctcgaagcacgacacctccaccaacgccaacgatccaaacgagtccgagctgcacaacctgctgtggaagaccattggacgcgaagccgacaacccgatgttcgtcgtctcccagaagtcccttaccggacactcaaagggcggtgcagcactcttccagatcggtggacttgtctccatcctggaaaccggcaagctgccacagaacgcatcccttgactgcgttgacccagagatggaagcaaagggcgagaacttcgtctggctgcgcaagccactggatctcggcgcaggctccattaaggccggcgtacttacctcactgggcttcggccacgtggctgcagtcgtcgtgctggcaaccagcggcatcttcgagcaggcaatgcgcaacgcaggcctcgacgtcgaagcatggcgtgcacgcgcaacccagcgcctgcgcaccggtgcaaaccgcctagaagctggcatggttggccgagcaccattgttcgagcaggtcgacggacgtcgcctgccagagcatggcgctcaccaagcagagatcaacttgcttatcgacgctgacgctcgcctcggtgctgacggcatctaccagggctaaacgttagatagctaagaaag

SEQ ID NO: 46 - protein, 1874 aa, Corynebacterium glutamicum
VRIVLTTEGEVAAKLVTRFAIRGRITTNEMAAPADSYGARDEVVEATPRSFIRQATVSAPADMTPFAMVSGDYNPIHTSDNAAKLVGLDAALVHGMWLSATAQHLAGLGSEVIGWTYSMYGMVQLNDVVDITVERVGRAGLKPAYEVTCRIDGNVVSRGQALLKAPSTAYVYPSQGIQAKGMGQGDRTASAEARAVWERADAHTRANLGFSIQQVIDENPTELKVGDTTFVHPAGVLNLTQFTQVALAVVAYAQTERLKAANAIVDGSLYAGHSLGEYTALASLGNIFELEGVIDVVFSRGSAMHSLVPRDEKGRSNYGLAAFRPNMINVAATEVENWVDRVAEESGEFLQIVNYNVDGQQYAVAGTLAGLKALKASASANPRAYVNIPGIDVPFHSSVLRPGVPAFAEKLDELLPETIDIDALRGRYIPNLVARPFELTQSFVDAILAVVPSERLKGIKVEDTDENTLARLLLIELLSWQFASPVRWIETQALIIDTVDQIIEVGLAASPTLTNLALRTMDVIGKSRPVFNVERDQDTVMLNDVRQAPVAEVEEEAVEEAPAAAAAPAAEAPVAAAPVAAAAPAPVGNAPELKFNAANAIMVLFAVQNKINIDQITAADTSETLTNGVSSRRNQMLMDMSTELSVPTIDGAADADVATLQGRVVTAAPGYKPFGPVLSETVRARLRALTGAAGLKTSYIGDRVTGTWGLPESWTAHVEVELLLGTREGESVRGGNLGSLPANASSKGDVDALIDAAVQNVAAANGTSVSMSSGGAASGGGVVDSAALDAYASTVTGEEGVLANVARGILSQLGLDTKDEVEGAEIDTELYDAVEAELGTGWLKLVTPVFSADRAILFDDRWASAREDLARLANGEDIAVERFAGTGETVVKQAAWWAEHVEDTALAATLKQVSEVAAKPANEPHIDDVALVTGAAPESIAGAVAARLLSQGATVILTASNVSQARKEYARKLYAANATPNAKLWIVPANMSSYRDVDAVIDWIGNEQRVTVGSTVTVTKPALTPTLAYPFAAPSVSGTLADAGPQAENQARLLLWSVERTIAGLADLASRGVDGRVHVVLPGSPNRGMFGGDGAYGEVKAAFDAILAKWGSETGWPQFVSLAQARIGWVAGTGLMGRNDVLIPAAEKLGIHVYTPEEISSELLGLASAESREKALEAPIDYDLTGGLSGGVSIAALAASLESDAVETTSAAEDTIKALPSPKHPEQPVGTPVGEVKTDLEDMVVMVGVGEVSSWGSGRTRFEAEYGIQRDGSVDLTAAGVLELAWMMGLISWSEDPKPAWYDADGTEVPEEEIYERFRDEVIARCGVRELVDDAFLVDGGSLDAAEVFLDRDISFSVTSAEEAQAYVDADASVTVEEADGEWIVTKKKGSTSFVPRKATLTRSVAGQLPTDFDPAKWGIPASMIDALDNIAAWNLVTAVDAFLSSGFSPAELLQSIHPADVSSTQGTGIGGMQSLRKLFVNRFLGQDRPSDILQETLPNVVAAHTMQSYVGGYGQMIHPVAACATAAVSVEEGVDKIRLNKADFVVAGGIDDIQVESLTGFGDMNATADTQAMLDKGIDPRFISRANDRRRAGFLEAAGGGTVLLARASVAAELGLPVLAVVAHAQSYADGAHTSIPAPGLGALGAARGGKKSVLARELNKLGLTPDDVRVVSKHDTSTNANDPNESELHNLLWKTIGREADNPMFVVSQKSLTGHSKGGAALFQIGGLVSILETGKLPQNASLDCVDPEMEAKGENFVWLRKPLDLGAGSIKAGVLTSLGFGHVAAVVVLATSGIFEQAMRNAGLDVEAWRARATQRLRTGANRLEAGMVGRAPLFEQVDGRRLPEHGAHQAEINLLIDADARLGADGIYQG

SEQ ID NO: 47 - DNA, 3317 bp, Corynebacterium glutamicum
  CDS (1)..(3294): FRXA00113
gcttcaggtggcggagttgttgattccgcagcacttgatgcctacgcatccaccgtcactggtgaagaaggcgtcctggcaaacgttgctcgcggcattctgtctcagcttggtctcgacaccaaggacgaggttgaaggcgcagagatcgacaccgaactctacgacgctgtcgaagcagaactgggcaccggctggctgaagcttgtcaccccagtgttctccgctgatcgtgcgatcttgttcgacgaccgttgggcatctgcacgtgaagatctggcacgccttgccaacggcgaggatattgccgtcgagcgctttgctggaacgggggagaccgtcgtcaagcaagctgcatggtgggctgagcacgttgaagacaccgctctcgctgcaaccctgaagcaggtttccgaggtggctgcgaagccagccaacgagccacacatcgacgatgttgcgctggttaccggtgcggctcctgagtcgatcgccggtgcagttgcggctcgcctgctgtcccagggcgcgaccgtcattctcaccgcatcgaacgtctcccaggcgcgtaaggaatacgcacgcaagctctacgctgcgaacgcaacccctaacgcaaagctgtggattgttcctgcgaacatgtcctcctaccgcgatgttgatgcagtcatcgattggatcggcaacgagcagcgcgtcaccgtcggcagcaccgtcaccgtgaccaagccagctctgaccccaacccttgcgtacccattcgcagctccatccgtatccggtaccttggcggatgcaggcccacaggctgaaaaccaggcacgcctgctcctctggtccgtggagcgcaccatcgcaggacttgcagatcttgcatcccgcggtgtcgatggacgcgtccacgttgtactcccaggttccccgaaccgcggaatgttcggtggcgacggcgcttacggcgaagtcaaggctgctttcgacgccatccttgccaagtggggctccgagaccggctggccacagtttgtctccctcgcacaggcacgcatcggctgggtcgcaggcaccggcctcatgggtcgcaacgacgtgctcatccctgccgctgaaaagctgggcatccacgtctacacccctgaagagatctcttccgaactgctgggtcttgcatccgcagaatcccgcgaaaaggctctggaagcaccgatcgattacgacctgaccggtggactttccggtggcgtatccatcgcagcactggcagcatccctcgagtccgacgcagtagagaccacctctgcagcagaagacaccatcaaggcgcttccatcacctaagcacccagagcagccagtgggcacgccagttggagaggtcaagaccgatctcgaagacatggttgtcatggttggcgttggcgaagtctcctcatggggctccggacgtacccgcttcgaagctgagtacggcatccagcgcgacggctccgttgacctcaccgcagcaggcgtccttgagcttgcatggatgatgggtctgatctcctggagcgaagatccaaagccagcctggtacgacgctgacggcaccgaagtgcctgaagaagagatctacgagcgcttccgcgacgaagtcatcgcacgatgcggtgttcgtgagcttgtcgacgacgcattcctcgtcgacggcggctccctcgacgcagctgaagtcttcctcgaccgcgacatctccttctccgtaacctctgctgaagaagcacaggcctacgtcgatgcagatgcttccgtgaccgttgaagaagcagacggcgaatggatcgtgaccaagaagaagggctccacctccttcgtgccacgcaaggcaaccctgacccgctccgtagcaggccagctgccaaccgacttcgaccctgccaagtggggtatcccagcctccatgatcgatgcactcgacaacatcgcagcgtggaacctggtcactgcagtcgacgccttcctgtcctccggcttcagcccagcagaactcctgcagtccatccacccagctgacgtgtcctccacccagggcaccggtatcggtggcatgcagtccctacgcaagctgttcgtcaaccgcttcctcggccaggatcgtccatccgacatcctccaggagaccctgccaaacgttgtggctgcacacaccatgcagtcctacgtcggtggctacggccagatgatccacccagtggcagcatgtgcaaccgcagctgtctccgtggaagaaggcgtggacaagatccgcctcaacaaggcagatttcgttgtcgccggtggtatcgatgacatccaggttgaatccctgaccggcttcggtgacatgaacgccaccgcagacacccaggcaatgctggacaagggcatcgacccacgcttcatctcccgcgcaaacgatcgacgtcgcgcaggcttcctcgaagcagcaggtggcggtaccgtcctcctggcacgtgcatccgttgctgctgaactgggactgccagttctcgcagttgttgcacacgcacagtcctacgccgatggtgctcacacctccatcccagcaccgggacttggcgcactgggtgcagcacgtggtggcaagaagtccgtacttgctcgcgaactgaacaaattgggtctgaccccagatgacgttcgcgtggtctcgaagcacgacacctccaccaacgccaacgatccaaacgagtccgagctgcacaacctgctgtggaagaccattggacgcgaagccgacaacccgatgttcgtcgtctcccagaagtcccttaccggacactcaaagggcggtgcagcactcttccagatcggtggacttgtctccatcctggaaaccggcaagctgccacagaacgcatcccttgactgcgttgacccagagatggaagcaaagggcgagaacttcgtctggctgcgcaagccactggatctcggcgcaggctccattaaggccggcgtacttacctcactgggcttcggccacgtggctgcagtcgtcgtgctggcaaccagcggcatcttcgagcaggcaatgcgcaacgcaggcctcgacgtcgaagcatggcgtgcacgcgcaacccagcgcctgcgcaccggtgcaaaccgcctagaagctggcatggttggccgagcaccattgttcgagcaggtcgacggacgtcgcctgccagagcatggcgctcaccaagcagagatcaacttgcttatcgacgctgacgctcgcctcggtgctgacggcatctaccagggctaaacgttagatagctaagaaag

SEQ ID NO: 48 - protein, 1098 aa, Corynebacterium glutamicum
ASGGGVVDSAALDAYASTVTGEEGVLANVARGILSQLGLDTKDEVEGAEIDTELYDAVEAELGTGWLKLVTPVFSADRAILFDDRWASAREDLARLANGEDIAVERFAGTGETVVKQAAWWAEHVEDTALAATLKQVSEVAAKPANEPHIDDVALVTGAAPESIAGAVAARLLSQGATVILTASNVSQARKEYARKLYAANATPNAKLWIVPANMSSYRDVDAVIDWIGNEQRVTVGSTVTVTKPALTPTLAYPFAAPSVSGTLADAGPQAENQARLLLWSVERTIAGLADLASRGVDGRVHVVLPGSPNRGMFGGDGAYGEVKAAFDAILAKWGSETGWPQFVSLAQARIGWVAGTGLMGRNDVLIPAAEKLGIHVYTPEEISSELLGLASAESREKALEAPIDYDLTGGLSGGVSIAALAASLESDAVETTSAAEDTIKALPSPKHPEQPVGTPVGEVKTDLEDMVVMVGVGEVSSWGSGRTRFEAEYGIQRDGSVDLTAAGVLELAWMMGLISWSEDPKPAWYDADGTEVPEEEIYERFRDEVIARCGVRELVDDAFLVDGGSLDAAEVFLDRDISFSVTSAEEAQAYVDADASVTVEEADGEWIVTKKKGSTSFVPRKATLTRSVAGQLPTDFDPAKWGIPASMIDALDNIAAWNLVTAVDAFLSSGFSPAELLQSIHPADVSSTQGTGIGGMQSLRKLFVNRFLGQDRPSDILQETLPNVVAAHTMQSYVGGYGQMIHPVAACATAAVSVEEGVDKIRLNKADFVVAGGIDDIQVESLTGFGDMNATADTQAMLDKGIDPRFISRANDRRRAGFLEAAGGGTVLLARASVAAELGLPVLAVVAHAQSYADGAHTSIPAPGLGALGAARGGKKSVLARELNKLGLTPDDVRVVSKHDTSTNANDPNESELHNLLWKTIGREADNPMFVVSQKSLTGHSKGGAALFQIGGLVSILETGKLPQNASLDCVDPEMEAKGENFVWLRKPLDLGAGSIKAGVLTSLGFGHVAAVVVLATSGIFEQAMRNAGLDVEAWRARATQRLRTGANRLEAGMVGRAPLFEQVDGRRLPEHGAHQAEINLLIDADARLGADGIYQG

SEQ ID NO: 49 - DNA, 6136 bp, Corynebacterium glutamicum
  CDS (101)..(6136): RXN03111
cgtgaccgaattgagcaggaacttcggggccagccgactgattaaccgctttggccaggagccttttgccttcgctttcgccggccaaggatatgactggttgaagacccttcgtgccgcggttgccgcaggtgcaggcaccaatgttagtgacatcgtcgagcgcgcaaatgcgctgcttgcactagttgcagatgatctcattggcacccttccatttggtttcgatccagtggcttgggctaacaactccgaagatccagctttcgatactgcacaatctgcagtgagcgtgccgggtatctttgtctcccagatcgcaaccctggattcccttgaggcgcagcgccttgatgtggatcaggctgtgtccagcattggtcattcccagggcgtattgggcgtgcacctgctcaatgatgcgactcgtgctgatgaactcgttgccattgcgcagttgatcggtgcagcgatcacccgcaccgcacgcatgacgggcctgatcgcgcagggcgacaacatgccgatgctgtcgatcgccggaatttcccgcgaacagcttcagcaagctatcgacgcggcctgcgccgaagtccctgcggagatccgcccggttatcggtctgcgcaactcacgcgattcttatgttttggttggccgcccagacgacaacgctcgcgttgttaaggtcattgaggcaatggctgccaaggataagaaggccattgaagataagctgcgcggcggttccgcgttcagcccccgtattactccgctgaaggtgcaggctgctttccatcacccagctatgaacatggctgtggagcagaccgtggcgtgggcaaccactgctggtttggatgtggaactcacccgcgagatcgccgctgatgttttggttaaccctgtcgattgggtagcacgcgtcaacgaagcgtatgaggctggcgctcgctggttcctcgacgttggaccagatggtggcatcgttaagctgactgccaacatccttgagggccgcggcgcggattccttctatgttggtgacgccgcaggccaggccaagatatttgatgctggcatggcacctgaacttccagtggattaccaggagttcgcaccacgcgttgagcacgttgatggaaccccacgcctggttaccaagttcactgagctgaccggccgcaccccaatgatgctggctggcatgaccccaaccaccgttgaccctgccattgttgcagccgctgcaaacggtggacactgggctgagctcgctggtggcggacaggttaccccagagctgctggaaacccacatcgcacagctcaccgacatgcttgagccaggtatcaacgcccagttcaactccatgttcttggatccatacctgtggaagatgcagattggtggcaagcgccttgttcctaaggcccgcgctaatggtgcatccatcgacggcatcgtcatcaccgccggcattcctgaaaaggatgaagctgttgcattggtcaaggaactgatgcgtgatggtttcccttggatcgcattcaagccaggtgccatcaagcaggttaactctgtgttggctatcgctaaggaagttccagaactccccatcatcattcagattgagggtggcgttgcaggtggacaccactcttgggaagacctcgatgagctgctgatcgccacctacggcaaggtccgcgcactggataacgtggtgctgtgtgtcggcggtggcattggctcacctgagcgcgctgctgattacgtcaccggttcctggtccacttcctacggcctgccagctatgcctgttgatggcatcttggtgggtaccgctgcgatggcaaccaaggaagcaaccacctcccaggccgtcaaggaacttcttgtttccacccagggctctgatgaatgggttcctgctggtggcgcaaagaacggaatggcatctggccgttcccagcttggcgcagacatccacgagatcgacaactcctttgctaaggctggacgccttcttgatgaggttgcaggcgatgagacggctgtgcaggcgcgccgggatgagatcattgaagcgattggcaagaccgccaaggtgtacttcggtgacatcggatccatgacttacgagcagtggctcaaccgctacctcgagctgtctggccctgttgatggtcagtggattgatgcttcctgggctgcacgttttgcccagatgctggagcgtgccgaggcgcgtttgatcgagcaggatcatggccaatttgagccaagcctgacggtggaggatggcgtcgacaagcttgttgctgcttacccgcatgccgcaaccgacctgctcaccccggctgatgtcgcctggttcttgggcctgtgccgcacgccgggcaagcctgtgaactttgtgcccgtcattgataaggacgtgcgtcgctggtggcgctcggactccctgtggcagtcccacgatgatcgctacaccgctgatcaggtggctattatccctggtgtcgtcgccgttgctggcatcaccaaggccaacgaacctgtcgctgacctgcttgatcgctttgtcgacgccaccatcgagcgcatcgatgagcacgattcccgctcccgcgacatcatgggcaaagtgctttcctcacctggcacattctgggctggccgcaacatcccatcggtgatccacagccttgggcatgctgacaagtggtcccgctccgaattcgaagcattccatagcccaaccggcgccaacttggtgtacgaagacgccgagcacgcgatgctgactgtgcctttggcgggttccaccgcattcggcaccaccgctgagctgaaaatccgtttcaccagccccatcgacgctctgccaagcgctgtcccactggtcacccaggaagacgctgaagccgcgatgggtgaactgacccgcatcgcagctggcggcaccctggcaactgtgaacaatggcaccgctacctgggaaacctccgtcgatgccggcgtcatcgctgactacaacaacgtcaccgcaggctacctgccagcatccgttgttcctgcacacaccgcacctgacgtgctggttggccgcgcatggccagcagttttcgctgccgtaaagtccgcagtcatcccaggcaccgattccgcatccgttgtggaaggcatgctgtccctggttcacctggagcaccacattgtgctcaagtccgatgtcccaaccgacggcgcgctgaaggtttccgcgactgccgatgaggtagtcgataccgacctgggtcgcctcgtgatcgtgcgcgcagaaatcgccgacgcagaaggcaacctgattgctacgttggctgagcgtttcgcgatccgcggacgcaagggcaacgctgtcgcacgcaccaacacctccgcactgccaaccaccgtggacaccccacgctcagctcgcgcagtggcaaccgttgttgcacctgaatccatgcgcccattcgctgtgatctccggtgaccgcaacccaattcacgtctctgatgttgcggcttccctggctggtctgccaggtgtgatcgtgcacggcatgtggacctctgccatcggtgaactgatcgccggtgcagcattcaacgatgagcagatccaaactcccgcagccaaggtcgtggaatacaccgcaaccatgctggcaccagttcttccaggtgaagaaattgagttcagcgttgagcgctccgcagtggacaaccgcccaggaatgggagaggtccgcaccgttaccgcaaccgtcaacggcaacttagtgcttaccgccaccgctgttgtggcagctccatctactttctacgcattcccaggccagggcattcagtcccagggcatgggtatggaagcacgccgtaactctcaggcagctcgcgctatctgggaccgcgccgatgcacacacccgcaataagctgggcttctccatcgtggaaatcgtggaaaacaacccacgcgaagtaaccgtggcaggggagaagttcttccacccagacggcgttttgtacctcacccagttcacccaggtgggcatggcaactctgggcgttgctcagatcgctgaaatgcgtgaagcacatgccttgaaccagcgtgcatactttgctggacactccgttggtgagtacaacgcgcttgctgcatatgctggtgtgctgtccctggaatccgttctggagatcgtttaccgtcgtggcttgaccatgcaccgcttggtggatcgcgatgaaaacggtctgtccaactacgcgctcgcagctcttcgccccaacaagatgggtctgaccgcagacaacgttttcgattacgttgcgtctgtttccgaagcttccggtgaattcctggagatcgttaactacaacttggctggcctgcagtacgcagttgctggaacccaggctggtcttgccgcccttcgtgccgatgttgagaaccgtgcaccaggtcagcgtgccttcattttgatccctggcattgacgtgccattccactcctccaagctgcgcgacggtgtgggcgcgttccgtgagcaccttgattccctgatcccagctgagctggatctggatgtgctggttggccgctacattccaaacttggtggctcgcccattcgaactcactgaagagttcgtggcatccatggcagaagtggtggagtccacctatgtcaatgagatcttggctgatttcaaggctgcttccgccgataagcagaagcttgcccgcacgttgcttattgagctgcttgcatggcagttcgcatcacctgtgcgctggatcgagactcaggatctgttgatcaagggccttcaagctgagcgtttcgtggaggtcggtgttggctctgctccaacgcttgccaacatgatgggccagaccctgcgccttcctcagtacgcggacgccaccattgaggtgttaaacattgagcgcgatcgcccagttgtgttcgctaccgatgaggttgtgcgtgaagtggcggttgaagagaccccagcagctcctgcagaaaccactgaaaccccagcaaccccagcaaccccagcccctgttgcagctgcagcccctgccaccggcggccctcgcccagatgacatcagcttcactccttctgatgccactgaaatgctcatcgctatctggaccaaggttcgcccagatcagatgggtgccactgattccatcgagaccctggttgagggcgtgtcctctcgccgtaaccagctcctgctggatcttggtgtggagttcggcctcggcgcaattgacggagcagccgatgctgagctcggtgatctaaaggtcaccgtgtccaagatggctaagggctacaaggcgtttggccctgtgctctccgatgctgcagctgatgccctgcgtcgcctcactggtcctaccggtaagcgcccgggatacatcgcagagcgcgtcaccggcacgtgggaattgggccagggctgggctgaccacgtggtcgctgaagttgtgatcggcgcccgcgaaggcgcatccctgcgcggcggcgacctggcgtcactgtctcctgcaagcccagcgtctgcatcagatcttgattcgcttatcgacgcagccgtccaggccgtagcctcccgccgcggcgttgcggtctccctgccttcagcaggcggcgctgccggtggcgtggttgattccgcagctcttggcgagtttgcagagcaggtcaccggacacgatggtgtgcttgctcaggcagcccgcaccatcttgacccagttgggtcttgataagccagcaaccgtttccgtggaagacaccgcagaggaagacctctacgagttggtctccaaggaactcggttctgattggccacgtcaggttgcaccaagcttcgatgaagaaaaggttgttctgcttgatgaccgttgggcttctgcgcgtgaggatctctccgcgttgctcttggcgaactcgcagcaactgatatcgatgtcacaggcgcaggcgaagctgttgcagcacaagctgaattctttggacttgatgatctcgcagctaggctcgcgaacaaagcttcttggactacgccgacaatgttgcggc

SEQ ID NO: 50 - protein, 2012 aa, Corynebacterium glutamicum
LKTLRAAVAAGAGTNVSDIVERANALLALVADDLIGTLPFGFDPVAWANNSEDPAFDTAQSAVSVPGIFVSQIATLDSLEAQRLDVDQAVSSIGHSQGVLGVHLLNDATRADELVAIAQLIGAAITRTARMTGLIAQGDNMPMLSIAGISREQLQQAIDAACAEVPAEIRPVIGLRNSRDSYVLVGRPDDNARVVKVIEAMAAKDKKAIEDKLRGGSAFSPRITPLKVQAAFHHPAMNMAVEQTVAWATTAGLDVELTREIAADVLVNPVDWVARVNEAYEAGARWFLDVGPDGGIVKLTANILEGRGADSFYVGDAAGQAKIFDAGMAPELPVDYQEFAPRVEHVDGTPRLVTKFTELTGRTPMMLAGMTPTTVDPAIVAAAANGGHWAELAGGGQVTPELLETHIAQLTDMLEPGINAQFNSMFLDPYLWKMQIGGKRLVPKARANGASIDGIVITAGIPEKDEAVALVKELMRDGFPWIAFKPGAIKQVNSVLAIAKEVPELPIIIQIEGGVAGGHHSWEDLDELLIATYGKVRALDNVVLCVGGGIGSPERAADYVTGSWSTSYGLPAMPVDGILVGTAAMATKEATTSQAVKELLVSTQGSDEWVPAGGAKNGMASGRSQLGADIHEIDNSFAKAGRLLDEVAGDETAVQARRDEIIEAIGKTAKVYFGDIGSMTYEQWLNRYLELSGPVDGQWIDASWAARFAQMLERAEARLIEQDHGQFEPSLTVEDGVDKLVAAYPHAATDLLTPADVAWFLGLCRTPGKPVNFVPVIDKDVRRWWRSDSLWQSHDDRYTADQVAIIPGVVAVAGITKANEPVADLLDRFVDATIERIDEHDSRSRDIMGKVLSSPGTFWAGRNIPSVIHSLGHADKWSRSEFEAFHSPTGANLVYEDAEHAMLTVPLAGSTAFGTTAELKIRFTSPIDALPSAVPLVTQEDAEAAMGELTRIAAGGTLATVNNGTATWETSVDAGVIADYNNVTAGYLPASVVPAHTAPDVLVGRAWPAVFAAVKSAVIPGTDSASVVEGMLSLVHLEHHIVLKSDVPTDGALKVSATADEVVDTDLGRLVIVRAEIADAEGNLIATLAERFAIRGRKGNAVARTNTSALPTTVDTPRSARAVATVVAPESMRPFAVISGDRNPIHVSDVAASLAGLPGVIVHGMWTSAIGELIAGAAFNDEQIQTPAAKVVEYTATMLAPVLPGEEIEFSVERSAVDNRPGMGEVRTVTATVNGNLVLTATAVVAAPSTFYAFPGQGIQSQGMGMEARRNSQAARAIWDRADAHTRNKLGFSIVEIVENNPREVTVAGEKFFHPDGVLYLTQFTQVGMATLGVAQIAEMREAHALNQRAYFAGHSVGEYNALAAYAGVLSLESVLEIVYRRGLTMHRLVDRDENGLSNYALAALRPNKMGLTADNVFDYVASVSEASGEFLEIVNYNLAGLQYAVAGTQAGLAALRADVENRAPGQRAFILIPGIDVPFHSSKLRDGVGAFREHLDSLIPAELDLDVLVGRYIPNLVARPFELTEEFVASMAEVVESTYVNEILADFKAASADKQKLARTLLIELLAWQFASPVRWIETQDLLIKGLQAERFVEVGVGSAPTLANMMGQTLRLPQYADATIEVLNIERDRPVVFATDEVVREVAVEETPAAPAETTETPATPATPAPVAAAAPATGGPRPDDISFTPSDATEMLIAIWTKVRPDQMGATDSIETLVEGVSSRRNQLLLDLGVEFGLGAIDGAADAELGDLKVTVSKMAKGYKAFGPVLSDAAADALRRLTGPTGKRPGYIAERVTGTWELGQGWADHVVAEVVIGAREGASLRGGDLASLSPASPASASDLDSLIDAAVQAVASRRGVAVSLPSAGGAAGGVVDSAALGEFAEQVTGHDGVLAQAARTILTQLGLDKPATVSVEDTAEEDLYELVSKELGSDWPRQVAPSFDEEKVVLLDDRWASAREDLSALLLANSQQLISMSQAQAKLLQHKLNSLDLMISQLGSRTKLLGLRRQCCG

SEQ ID NO: 51 - DNA, 2185 bp, Corynebacterium glutamicum
  CDS (101)..(2185): FRXA00158
cgtgccattttctttacaaaagagtattaaccgaaacttcaggtcaggatccacgccctgcgttcatcccggctaagttatacaaggagcgagttctcacgtgaccgaattgagcaggaacttcggggccagccgactgattaaccgctttggccaggagccttttgccttcgctttcgccggccaaggatatgactggttgaagacccttcgtgccgcggttgccgcaggtgcaggcaccaatgttagtgacatcgtcgagcgcgcaaatgcgctgcttgcactagttgcagatgatctcattggcacccttccatttggtttcgatccagtggcttgggctaacaactccgaagatccagctttcgatactgcacaatctgcagtgagcgtgccgggtatctttgtctcccagatcgcaaccctggattcccttgaggcgcagcgccttgatgtggatcaggctgtgtccagcattggtcattcccagggcgtattgggcgtgcacctgctcaatgatgcgactcgtgctgatgaactcgttgccattgcgcagttgatcggtgcagcgatcacccgcaccgcacgcatgacgggcctgatcgcgcagggcgacaacatgccgatgctgtcgatcgccggaatttcccgcgaacagcttcagcaagctatcgacgcggcctgcgccgaagtccctgcggagatccgcccggttatcggtctgcgcaactcacgcgattcttatgttttggttggccgcccagacgacaacgctcgcgttgttaaggtcattgaggcaatggctgccaaggataagaaggccattgaagataagctgcgcggcggttccgcgttcagcccccgtattactccgctgaaggtgcaggctgctttccatcacccagctatgaacatggctgtggagcagaccgtggcgtgggcaaccactgctggtttggatgtggaactcacccgcgagatcgccgctgatgttttggttaaccctgtcgattgggtagcacgcgtcaacgaagcgtatgaggctggcgctcgctggttcctcgacgttggaccagatggtggcatcgttaagctgactgccaacatccttgagggccgcggcgcggattccttctatgttggtgacgccgcaggccaggccaagatatttgatgctggcatggcacctgaacttccagtggattaccaggagttcgcaccacgcgttgagcacgttgatggaaccccacgcctggttaccaagttcactgagctgaccggccgcaccccaatgatgctggctggcatgaccccaaccaccgttgaccctgccattgttgcagccgctgcaaacggtggacactgggctgagctcgctggtggcggacaggttaccccagagctgctggaaacccacatcgcacagctcaccgacatgcttgagccaggtatcaacgcccagttcaactccatgttcttggatccatacctgtggaagatgcagattggtggcaagcgccttgttcctaaggcccgcgctaatggtgcatccatcgacggcatcgtcatcaccgccggcattcctgaaaaggatgaagctgttgcattggtcaaggaactgatgcgtgatggtttcccttggatcgcattcaagccaggtgccatcaagcaggttaactctgtgttggctatcgctaaggaagttccagaactccccatcatcattcagattgagggtggcgttgcaggtggacaccactcttgggaagacctcgatgagctgctgatcgccacctacggcaaggtccgcgcactggataacgtggtgctgtgtgtcggcggtggcattggctcacctgagcgcgctgctgattacgtcaccggttcctggtccacttcctacggcctgccagctatgcctgttgatggcatcttggtgggtaccgctgcgatggcaaccaaggaagcaaccacctcccaggccgtcaaggaacttcttgtttccacccagggctctgatgaatgggttcctgctggtggcgcaaagaacggaatggcatatggccgttcccagcttggcgcagacatccacgagatcgacaactcctttgctaaggctggacgccttcttgatgaggttgcaggccatgaaacggatttgcaagcgcgcccggatgagatcatt

SEQ ID NO: 52 - protein, 695 aa, Corynebacterium glutamicum
VTELSRNFGASRLINRFGQEPFAFAFAGQGYDWLKTLRAAVAAGAGTNVSDIVERANALLALVADDLIGTLPFGFDPVAWANNSEDPAFDTAQSAVSVPGIFVSQIATLDSLEAQRLDVDQAVSSIGHSQGVLGVHLLNDATRADELVAIAQLIGAAITRTARMTGLIAQGDNMPMLSIAGISREQLQQAIDAACAEVPAEIRPVIGLRNSRDSYVLVGRPDDNARVVKVIEAMAAKDKKAIEDKLRGGSAFSPRITPLKVQAAFHHPAMNMAVEQTVAWATTAGLDVELTREIAADVLVNPVDWVARVNEAYEAGARWFLDVGPDGGIVKLTANILEGRGADSFYVGDAAGQAKIFDAGMAPELPVDYQEFAPRVEHVDGTPRLVTKFTELTGRTPMMLAGMTPTTVDPAIVAAAANGGHWAELAGGGQVTPELLETHIAQLTDMLEPGINAQFNSMFLDPYLWKMQIGGKRLVPKARANGASIDGIVITAGIPEKDEAVALVKELMRDGFPWIAFKPGAIKQVNSVLAIAKEVPELPIIIQIEGGVAGGHHSWEDLDELLIATYGKVRALDNVVLCVGGGIGSPERAADYVTGSWSTSYGLPAMPVDGILVGTAAMATKEATTSQAVKELLVSTQGSDEWVPAGGAKNGMAYGRSQLGADIHEIDNSFAKAGRLLDEVAGHETDLQARPDEII

SEQ ID NO: 53 - DNA, 3831 bp, Corynebacterium glutamicum
  CDS (1)..(3831): FRXA00572
cagtggctcaaccgctacctcgagctgtctggccctgttgatggtcagtggattgatgcttcctgggctgcacgttttgcccagatgctggagcgtgccgaggcgcgtttgatcgagcaggatcatggccaatttgagccaagcctgacggtggaggatggcgtcgacaagcttgttgctgcttacccgcatgccgcaaccgacctgctcaccccggctgatgtcgcctggttcttgggcctgtgccgcacgccgggcaagcctgtgaactttgtgcccgtcattgataaggacgtgcgtcgctggtggcgctcggactccctgtggcagtcccacgatgatcgctacaccgctgatcaggtggctattatccctggtgtcgtcgccgttgctggcatcaccaaggccaacgaacctgtcgctgacctgcttgatcgctttgtcgacgccaccatcgagcgcatcgatgagcacgattcccgctcccgcgacatcatgggcaaagtgctttcctcacctggcacattctgggctggccgcaacatcccatcggtgatccacagccttgggcatgctgacaagtggtcccgctccgaattcgaagcattccatagcccaaccggcgccaacttggtgtacgaagacgccgagcacgcgatgctgactgtgcctttggcgggttccaccgcattcggcaccaccgctgagctgaaaatccgtttcaccagccccatcgacgctctgccaagcgctgtcccactggtcacccaggaagacgctgaagccgcgatgggtgaactgacccgcatcgcagctggcggcaccctggcaactgtgaacaatggcaccgctacctgggaaacctccgtcgatgccggcgtcatcgctgactacaacaacgtcaccgcaggctacctgccagcatccgttgttcctgcacacaccgcacctgacgtgctggttggccgcgcatggccagcagttttcgctgccgtaaagtccgcagtcatcccaggcaccgattccgcatccgttgtggaaggcatgctgtccctggttcacctggagcaccacattgtgctcaagtccgatgtcccaaccgacggcgcgctgaaggtttccgcgactgccgatgaggtagtcgataccgacctgggtcgcctcgtgatcgtgcgcgcagaaatcgccgacgcagaaggcaacctgattgctacgttggctgagcgtttcgcgatccgcggacgcaagggcaacgctgtcgcacgcaccaacacctccgcactgccaaccaccgtggacaccccacgctcagctcgcgcagtggcaaccgttgttgcacctgaatccatgcgcccattcgctgtgatctccggtgaccgcaacccaattcacgtctctgatgttgcggcttccctggctggtctgccaggtgtgatcgtgcacggcatgtggacctctgccatcggtgaactgatcgccggtgcagcattcaacgatgagcagatccaaactcccgcagccaaggtcgtggaatacaccgcaaccatgctggcaccagttcttccaggtgaagaaattgagttcagcgttgagcgctccgcagtggacaaccgcccaggaatgggagaggtccgcaccgttaccgcaaccgtcaacggcaacttagtgcttaccgccaccgctgttgtggcagctccatctactttctacgcattcccaggccagggcattcagtcccagggcatgggtatggaagcacgccgtaactctcaggcagctcgcgctatctgggaccgcgccgatgcacacacccgcaataagctgggcttctccatcgtggaaatcgtggaaaacaacccacgcgaagtaaccgtggcaggggagaagttcttccacccagacggcgttttgtacctcacccagttcacccaggtgggcatggcaactctgggcgttgctcagatcgctgaaatgcgtgaagcacatgccttgaaccagcgtgcatactttgctggacactccgttggtgagtacaacgcgcttgctgcatatgctggtgtgctgtccctggaatccgttctggagatcgtttaccgtcgtggcttgaccatgcaccgcttggtggatcgcgatgaaaacggtctgtccaactacgcgctcgcagctcttcgccccaacaagatgggtctgaccgcagacaacgttttcgattacgttgcgtctgtttccgaagcttccggtgaattcctggagatcgttaactacaacttggctggcctgcagtacgcagttgctggaacccaggctggtcttgccgcccttcgtgccgatgttgagaaccgtgcaccaggtcagcgtgccttcattttgatccctggcattgacgtgccattccactcctccaagctgcgcgacggtgtgggcgcgttccgtgagcaccttgattccctgatcccagctgagctggatctggatgtgctggttggccgctacattccaaacttggtggctcgcccattcgaactcactgaagagttcgtggcatccatggcagaagtggtggagtccacctatgtcaatgagatcttggctgatttcaaggctgcttccgccgataagcagaagcttgcccgcacgttgcttattgagctgcttgcatggcagttcgcatcacctgtgcgctggatcgagactcaggatctgttgatcaagggccttcaagctgagcgtttcgtggaggtcggtgttggctctgctccaacgcttgccaacatgatgggccagaccctgcgccttcctcagtacgcggacgccaccattgaggtgttaaacattgagcgcgatcgcccagttgtgttcgctaccgatgaggttgtgcgtgaagtggcggttgaagagaccccagcagctcctgcagaaaccactgaaaccccagcaaccccagcaaccccagcccctgttgcagctgcagcccctgccaccggcggccctcgcccagatgacatcagcttcactccttctgatgccactgaaatgctcatcgctatctggaccaaggttcgcccagatcagatgggtgccactgattccatcgagaccctggttgagggcgtgtcctctcgccgtaaccagctcctgctggatcttggtgtggagttcggcctcggcgcaattgacggagcagccgatgctgagctcggtgatctaaaggtcaccgtgtccaagatggctaagggctacaaggcgtttggccctgtgctctccgatgctgcagctgatgccctgcgtcgcctcactggtcctaccggtaagcgcccgggatacatcgcagagcgcgtcaccggcacgtgggaattgggccagggctgggctgaccacgtggtcgctgaagttgtgatcggcgcccgcgaaggcgcatccctgcgcggcggcgacctggcgtcactgtctcctgcaagcccagcgtctgcatcagatcttgattcgcttatcgacgcagccgtccaggccgtagcctcccgccgcggcgttgcggtctccctgccttcagcaggcggcgctgccggtggcgtggttgattccgcagctcttggcgagtttgcagagcaggtcaccggacacgatggtgtgcttgctcaggcagcccgcaccatcttgacccagttgggtcttgataagccagcaaccgtttccgtggaagacaccgcagaggaagacctctacgagttggtctccaaggaactcggttctgattggccacgtcaggttgcaccaagcttcgatgaagaaaaggttgttctgcttgatgaccgttgggcttctgcgcgtgag

SEQ ID NO: 54 - protein, 1277 aa, Corynebacterium glutamicum
QWLNRYLELSGPVDGQWIDASWAARFAQMLERAEARLIEQDHGQFEPSLTVEDGVDKLVAAYPHAATDLLTPADVAWFLGLCRTPGKPVNFVPVIDKDVRRWWRSDSLWQSHDDRYTADQVAIIPGVVAVAGITKANEPVADLLDRFVDATIERIDEHDSRSRDIMGKVLSSPGTFWAGRNIPSVIHSLGHADKWSRSEFEAFHSPTGANLVYEDAEHAMLTVPLAGSTAFGTTAELKIRFTSPIDALPSAVPLVTQEDAEAAMGELTRIAAGGTLATVNNGTATWETSVDAGVIADYNNVTAGYLPASVVPAHTAPDVLVGRAWPAVFAAVKSAVIPGTDSASVVEGMLSLVHLEHHIVLKSDVPTDGALKVSATADEVVDTDLGRLVIVRAEIADAEGNLIATLAERFAIRGRKGNAVARTNTSALPTTVDTPRSARAVATVVAPESMRPFAVISGDRNPIHVSDVAASLAGLPGVIVHGMWTSAIGELIAGAAFNDEQIQTPAAKVVEYTATMLAPVLPGEEIEFSVERSAVDNRPGMGEVRTVTATVNGNLVLTATAVVAAPSTFYAFPGQGIQSQGMGMEARRNSQAARAIWDRADAHTRNKLGFSIVEIVENNPREVTVAGEKFFHPDGVLYLTQFTQVGMATLGVAQIAEMREAHALNQRAYFAGHSVGEYNALAAYAGVLSLESVLEIVYRRGLTMHRLVDRDENGLSNYALAALRPNKMGLTADNVFDYVASVSEASGEFLEIVNYNLAGLQYAVAGTQAGLAALRADVENRAPGQRAFILIPGIDVPFHSSKLRDGVGAFREHLDSLIPAELDLDVLVGRYIPNLVARPFELTEEFVASMAEVVESTYVNEILADFKAASADKQKLARTLLIELLAWQFASPVRWIETQDLLIKGLQAERFVEVGVGSAPTLANMMGQTLRLPQYADATIEVLNIERDRPVVFATDEVVREVAVEETPAAPAETTETPATPATPAPVAAAAPATGGPRPDDISFTPSDATEMLIAIWTKVRPDQMGATDSIETLVEGVSSRRNQLLLDLGVEFGLGAIDGAADAELGDLKVTVSKMAKGYKAFGPVLSDAAADALRRLTGPTGKRPGYIAERVTGTWELGQGWADHVVAEVVIGAREGASLRGGDLASLSPASPASASDLDSLIDAAVQAVASRRGVAVSLPSAGGAAGGVVDSAALGEFAEQVTGHDGVLAQAARTILTQLGLDKPATVSVEDTAEEDLYELVSKELGSDWPRQVAPSFDEEKVVLLDDRWASARE

SEQ ID NO: 55 - DNA, 4953 bp, Corynebacterium glutamicum; identical to SEQ ID NO: 13
  CDS (101)..(4930): RXA02582

SEQ ID NO: 56 - protein, 1610 aa, Corynebacterium glutamicum; identical to SEQ ID NO: 14

SEQ ID NO: 57 - DNA, 930 bp, Corynebacterium glutamicum
  CDS (101)..(907): RXA02691
cttagggcttatctgttttccagccttgctttttactaggcgctcctgtcccgcttcagtcaccaaaaccacacccctggttatgaccagatcggctaaaatgaacaccatgcctgaccaaccgctcaaccaggacggattccctaccgcatccaaaggggtggaacccgacaacctccccgaccgcgttctcgtggacggccttaaaccaaagcatcagcagcttcgtgaaattttggaggaaatctgcaccacccagcttcagcctggggacatgctgcctggtgagcgcatcctggaagaaaagtatggcgtcagccgaattacggttcgtcgggcgattggtgatctggtcgcgtccggcaggttgaagcgagctcgcggcaaaggtaccttcgtggcccactcgccgttgatttcccgcctgcatttggcctcgttttccgcagagatggccgcccagaagctatcggctaccagcaggattttgagttcttcccgcggtcccgccccagatgatattgctgatttctttggtaccgatcgcgcggcccagcacatcacgttgcgccgcctgcgctttggaaatggtcgaccctatgccattgacaacggttggtacaactccgaattcgcacctgacctgctggaaaatgatgtgtacaactccgtgtactccatcctggaccgcgtctatggcgtccccgtcacccaggccgagcaaacggtcaccgccgtagcagccgacgaagacaccgcacggcttctggacgtcacccccggcgccccactccttcgtatccttcgacagtcactttctggcgataagcccgtggaatggtgcgtttccttgtaccgaaccgaccgatattctttaaaaacattggttacacgctccgaagatctctgacgtgaacccattttggtggc

SEQ ID NO: 58 - protein, 269 aa, Corynebacterium glutamicum
MNTMPDQPLNQDGFPTASKGVEPDNLPDRVLVDGLKPKHQQLREILEEICTTQLQPGDMLPGERILEEKYGVSRITVRRAIGDLVASGRLKRARGKGTFVAHSPLISRLHLASFSAEMAAQKLSATSRILSSSRGPAPDDIADFFGTDRAAQHITLRRLRFGNGRPYAIDNGWYNSEFAPDLLENDVYNSVYSILDRVYGVPVTQAEQTVTAVAADEDTARLLDVTPGAPLLRILRQSLSGDKPVEWCVSLYRTDRYSLKTLVTRSEDL

SEQ ID NO: 59 - DNA, 1968 bp, Corynebacterium glutamicum
  CDS (101)..(1945): RXA00880
tccatgtggttaaagatatgcctaaagatctgaccaaaaacgtgactaaagacgtgacgacacaagtacagccaaattaaaggaaaggttgaatttgaccatgacttcacctaataccctgcaggaatacactgaacctgccaagtacaccatcggagaatctgaaacctgcctgaccgcccttctagatcagattaagactcgaccttacggagttttgttcagcaagcctgccaactatgagtgggtgaatgtaactgccaaagaatttcaggacgaggtttttgcggttgcaaaaggaattatttcagtcggcgtagagcagggagaccgtgtcgcgctgctgtccaatactcgctatgagtgggctgtgcttgatttcgctatctgggccgctggcgcagtgagcgtgcctatctacagctcctcttcactgtcccaaattgagtggatcattgaggattccggcgctgttttggccattaccgaaacccctgatcataccgacttgatgaagaacctggtcatcggtgaagacggaactccagcgattaagggttcaccttccaagctgcgccgcattctagagatcaactcttcggcgttggagaccttgaagtttgagggccgcgagctttctgatgagctggtgtgggaacgcattcatgcaaccaaggccgctgacctggcgtctttggtgtacacctctggcacaactggtaggccgaagggctgcgagttgtcccactaccactggttggctgaggtccgagcgctgatcaccaatgacatcggagcgatcgcgatgccaggttcaaggttgctcaccttccttcctttggcgcacgttcttgctcgcgcagtgcacttggccttcgctgtcaccggtgcaacccagtcccactggtctgatttcagcacccttactttggaactgcagcgttcccgcccgaacctgattttgggtgttccacgcgtgtttgaaaaggtccgcaacgccgctgctgctaatgctgctgacggtggcgcaatcaagcgcatcatgtttgagcgtgccgaaaaggcggccattgaatactccatggctcttgatactgcagaaggcccaagcaagtcccaggttatggcacataaagcgtttgacaagctggtgtactccaagatccgtgcagctgtcggtggcgatgtgcagtacgccatcaccggtggttcagcgatggggcaggagctgctgcacttcttccgcggtgtgggcatgaccatctacgaaggttatggtctgacggaatctgcggctgctgcagcggtggacttcactgatcaaaagatcggcactgtgggtaagccgatgggtggcatgaccatcaagatcaatgaagatggcgaaatcatgctaaaaggcgagatgttgttccagggatattggaacaacccagaagccacagcagaagccctccacgacggttggttcaacaccggcgatctgggtgagctgttggagtctggacacctggtgatcaccggacgtaagaaagatctgatcgtgaccgcgggcggcaagaacgtttccccaggacccatggaagacatcatccgcgcacacccactggtcagccaggccatggtggtgggcgatggtaaaccattcgttggcctgctggtgaccttggatccagatatgttgaagcggtggaagctgaaccacaacattgcggaatcccgcacggtttctgagattgctactgatcctgcactgcgtgcggaaatccaggatgcagtcaacaacgctaatgccacggtgtctcattcagaggcgatcaagcggttctacatccttgatcgcgacctgaccgaggaagccgacgagctgaccccaacgctgaaggtcaagcgcaacgttgttgttcgccgttacgcagacgccatcgaccacatctacaaccgatgagtaacacagagacccaattt

SEQ ID NO: 60 - protein, 615 aa, Corynebacterium glutamicum
MTSPNTLQEYTEPAKYTIGESETCLTALLDQIKTRPYGVLFSKPANYEWVNVTAKEFQDEVFAVAKGIISVGVEQGDRVALLSNTRYEWAVLDFAIWAAGAVSVPIYSSSSLSQIEWIIEDSGAVLAITETPDHTDLMKNLVIGEDGTPAIKGSPSKLRRILEINSSALETLKFEGRELSDELVWERIHATKAADLASLVYTSGTTGRPKGCELSHYHWLAEVRALITNDIGAIAMPGSRLLTFLPLAHVLARAVHLAFAVTGATQSHWSDFSTLTLELQRSRPNLILGVPRVFEKVRNAAAANAADGGAIKRIMFERAEKAAIEYSMALDTAEGPSKSQVMAHKAFDKLVYSKIRAAVGGDVQYAITGGSAMGQELLHFFRGVGMTIYEGYGLTESAAAAAVDFTDQKIGTVGKPMGGMTIKINEDGEIMLKGEMLFQGYWNNPEATAEALHDGWFNTGDLGELLESGHLVITGRKKDLIVTAGGKNVSPGPMEDIIRAHPLVSQAMVVGDGKPFVGLLVTLDPDMLKRWKLNHNIAESRTVSEIATDPALRAEIQDAVNNANATVSHSEAIKRFYILDRDLTEEADELTPTLKVKRNVVVRRYADAIDHIYNR

SEQ ID NO: 61 - DNA, 1047 bp, Corynebacterium glutamicum
  CDS (101)..(1024): RXA01060
ttccatttacacatctgttcgactcgcgcccgaatgatgtcgcatcaacatgagaagctacttccatacttttactgattgataagaatggacaaagacaatgaaccgcacactccgaacacttggctggcttgctgccgtaattcaagaagatccggagccctggttcaccactgatcccgacaccgattatgtcccttatgtaaatagtttctcatttgaatccctttccctcgttccagatgctctgatgctgctcaaacgttctcttcaccttgcgatggagcaacaggacctcccagtgaaggatctacaagaagcactgaggcacgtactagttttcaaattccacttcagggaagaatgggagctggaattagcatgggactccgagcggaccaagtctgcggtgagaattattgagagcacaaaagaatctcttgccgatcaatacagagattacaaatacgcattcttgcctgagctaattttccaggaatcacgcgggatctttgactttgagctggagggatacaccctcaaagtaggacaaagcacgctttccattccttgggacatgatcgccaatggttatgtccctgcaagtcttcggaattttggagaattaatggaccgtgacaccggagatcttgatgcagatcccattctgagacctcgagaactcaaatttgagatccataattgtccagatcttaatccttggataatgcgggaaacttttgatttcatgatggaaatcgcaactgaaacaggatggttccatgctctcaaccccgcatataattccgtctacacctacgatcttatttctcgcatgccagatttccttgttgaagggagctttcgtccgcattcagtgaaacgatcttgggaaaaaattcaaaagatagctaaagctgttgagtcttatgcatctcacgattactgcatgtcaacgctgacacatgactacagggcaatcgagttatccctgacgcctacaaaaactgaggaaccaagcacataagaaaacctcgcctgcccact

SEQ ID NO: 62 - protein, 308 aa, Corynebacterium glutamicum
MNRTLRTLGWLAAVIQEDPEPWFTTDPDTDYVPYVNSFSFESLSLVPDALMLLKRSLHLAMEQQDLPVKDLQEALRHVLVFKFHFREEWELELAWDSERTKSAVRIIESTKESLADQYRDYKYAFLPELIFQESRGIFDFELEGYTLKVGQSTLSIPWDMIANGYVPASLRNFGELMDRDTGDLDADPILRPRELKFEIHNCPDLNPWIMRETFDFMMEIATETGWFHALNPAYNSVYTYDLISRMPDFLVEGSFRPHSVKRSWEKIQKIAKAVESYASHDYCMSTLTHDYRAIELSLTPTKTEEPST

SEQ ID NO: 63 - DNA, 1848 bp, Corynebacterium glutamicum
  CDS (101)..(1825): RXN01722
ctcattcccctcgctaaaagctgcataaagtttcgacgttttcaaagttgattgcttgcactgtcgttgcgtgtcgcatgccccggctattgttgattgcatgctcagcacgatgcaggacgtcccactgtcattaaccagaatcctcgagtacgggtccactgttcacggtgatactttgatcaccacgtggggcggtgccgatggcattgaacaagcacagcaaacttttagtgctgtgggggctagagctgcggctttggctcatgcgctgcatgattctttaggtattactggggatcagcgagtggcgtcgatgctctataactgcgcggaacacatggaaactatgtttgcagtcgcatgcatgggtgccgtgtttaatccgctgaacaagcagttgatgaatgatcagattgtgttcattctcaatcactctgaagctgaagtggttatcgctgatccgcgcatggctgaacaattgggtgagatcttaaaagaaacaccaaaagttcgtgccgtggtgtttattggaccgaatgatttctctagcgcggcggcccacatgccggagggaatgaagctgtattcctatgaagcgctccttgacggccgttccactgtttacaactggcccgagcaggatgaacgcactgctgctgcaatttgctattccaccggtacatcgggaccgccgaagggtgtggtgtattcccaccgctcgctttatttacagtcgttgagcttgcgcaccacggattccctcgcagtggaacacggcgaaacgttcctgtgctgtgtgccgatttaccacgtcctcagctggggcgtgccgatcgcagcgtttatgtccggcactcccctggtgcttcctggaccggatctttctgcgccgacattggcaaagatcatttccaccacgctgcctcgcgtggcgcatggcgtgcctactctctggattcagctgatggttcactacctgaaaaatcccccagagcgtatgtctctgcgtgagctatacgtgggcggttctgcggtgcctccaatcgtgatcaccatgtgggagcagcgctatggcgtggatgttgtccacgtgtggggtatgacggaaacctccaccgtgggtactgtgtctcgcccaccatcaggtgtttctggtgaaagccggtggaattatcgagtctcccagggccgattccccgcctccctgcagtaccgcattgtcaacgacggccaggtcatggcgtccaccgaccgcaacgagggcgagattcaggtccgcggtccgtgggtgactgcaagttacttccaccccgatgtggaaaaagaaggtggcaccgcctcaacattccgcgaccatgacgttgaagaggaaaacgatgagctcttcaccgccgacggctggctgcgcaccggggacgttggatctgtcaccagcgatggattcctcaccatccaagaccgcgcccgcgatgtcatccgttctggcggcgagtggatttactccgctcagctggaaaacctcatcgtggctacggaagaggttgtcgaatgcgccgtcattggcttccccgatgacaagtgggtggaacgtcccctcgcagtcaccatgctctaccccggcattgaacgcacccgggaaaccgccgagcgcctccgcgatcaacttcgcgaccgcctacccaactggatgctgccagaatattggacatttgttgatgaggtggataaaacctccgtcggtaaatatgacaagaaggacctccgcaaccacctgcgcaacggcgatttcgaagtaattaagcttaaagggccaggtgaaaaataacttccctatttattccggct

SEQ ID NO: 64 - protein, 575 aa, Corynebacterium glutamicum
MLSTMQDVPLSLTRILEYGSTVHGDTLITTWGGADGIEQAQQTFSAVGARAAALAHALHDSLGITGDQRVASMLYNCAEHMETMFAVACMGAVFNPLNKQLMNDQIVFILNHSEAEVVIADPRMAEQLGEILKETPKVRAVVFIGPNDFSSAAAHMPEGMKLYSYEALLDGRSTVYNWPEQDERTAAAICYSTGTSGPPKGVVYSHRSLYLQSLSLRTTDSLAVEHGETFLCCVPIYHVLSWGVPIAAFMSGTPLVLPGPDLSAPTLAKIISTTLPRVAHGVPTLWIQLMVHYLKNPPERMSLRELYVGGSAVPPIVITMWEQRYGVDVVHVWGMTETSTVGTVSRPPSGVSGESRWNYRVSQGRFPASLQYRIVNDGQVMASTDRNEGEIQVRGPWVTASYFHPDVEKEGGTASTFRDHDVEEENDELFTADGWLRTGDVGSVTSDGFLTIQDRARDVIRSGGEWIYSAQLENLIVATEEVVECAVIGFPDDKWVERPLAVTMLYPGIERTRETAERLRDQLRDRLPNWMLPEYWTFVDEVDKTSVGKYDKKDLRNHLRNGDFEVIKLKGPGEK

SEQ ID NO: 65 - DNA, 1848 bp, Corynebacterium glutamicum
  CDS (101)..(1825): FRXA01722
  unsure 479: Xaa indicates any amino acid
  unsure 574: Xaa indicates any amino acid
ctcattcccctcgctaaaagctgcataaagtttcgacgttttcaaagttgattgcttgcactgtcgttgcgtgtcgcatgccccggctattgttgattgcatgctcagcacgatgcaggacgtcccactgtcattaaccagaatcctcgagtacgggtccactgttcacggtgatactttgatcaccacgtggggcggtgccgatggcattgaacaagcacagcaaacttttagtgctgtgggggctagagctgcggctttggctcatgcgctgcatgattctttaggtattactggggatcagcgagtggcgtcgatgctctataactgcgcggaacacatggaaactatgtttgcagtcgcatgcatgggtgccgtgtttaatccgctgaacaagcagttgatgaatgatcagattgtgttcattctcaatcactctgaagctgaagtggttatcgctgatccgcgcatggctgaacaattgggtgagatcttaaaagaaacaccaaaagttcgtgccgtggtgtttattggaccgaatgatttctctagcgcggcggcccacatgccggagggaatgaagctgtattcctatgaagcgctccttgacggccgttccactgtttacaactggcccgagcaggatgaacgcactgctgctgcaatttgctattccaccggtacatcgggaccgccgaagggtgtggtgtattcccaccgctcgctttatttacagtcgttgagcttgcgcaccacggattccctcgcagtggaacacggcgaaacgttcctgtgctgtgtgccgatttaccacgtcctcagctggggcgtgccgatcgcagcgtttatgtccggcactcccctggtgcttcctggaccggatctttctgcgccgacattggcaaagatcatttccaccacgctgcctcgcgtggcgcatggcgtgcctactctctggattcagctgatggttcactacctgaaaaatcccccagagcgtatgtctctgcgtgagctatacgtgggcggttctgcggtgcctccaatcgtgatcaccatgtgggagcagcgctatggcgtggatgttgtccacgtgtggggtatgacggaaacctccaccgtgggtactgtgtctcgcccaccatcaggtgtttctggtgaaagccggtggaattatcgagtctcccagggccgattccccgcctccctgcagtaccgcattgtcaacgacggccaggtcatggcgtccaccgaccgcaacgagggcgagattcaggtccgcggtccgtgggtgactgcaagttacttccaccccgatgtggaaaaagaaggtggcaccgcctcaacattccgcgaccatgacgttgaagaggaaaacgatgagctcttcaccgccgacggctggctgcgcaccggggacgttggatctgtcaccagcgatggattcctcaccatccaagaccgcgcccgcgatgtcatccgttctggcggcgagtggatttactccgctcagctggaaaacctcatcgtggctacsgaagaggttgtcgaatgcgccgtcattggcttccccgatgacaagtgggtggaacgtcccctcgcagtcaccatgctctaccccggcattgaacgcacccgggaaaccgccgagcgcctccgcgatcaacttcgcgaccgcctacccaactggatgctgccagaatattggacatttgttgatgaggtggataaaacctccgtcggtaaatatgacaagaaggacctccgcaaccacctgcgcaacggcgatttcgaagtaattaagcttaaagggccaggtgaraaataacttccctatttattccggct

SEQ ID NO: 66 - protein, 575 aa, Corynebacterium glutamicum
  unsure 479: Xaa indicates any amino acid
  unsure 574: Xaa indicates any amino acid
MLSTMQDVPLSLTRILEYGSTVHGDTLITTWGGADGIEQAQQTFSAVGARAAALAHALHDSLGITGDQRVASMLYNCAEHMETMFAVACMGAVFNPLNKQLMNDQIVFILNHSEAEVVIADPRMAEQLGEILKETPKVRAVVFIGPNDFSSAAAHMPEGMKLYSYEALLDGRSTVYNWPEQDERTAAAICYSTGTSGPPKGVVYSHRSLYLQSLSLRTTDSLAVEHGETFLCCVPIYHVLSWGVPIAAFMSGTPLVLPGPDLSAPTLAKIISTTLPRVAHGVPTLWIQLMVHYLKNPPERMSLRELYVGGSAVPPIVITMWEQRYGVDVVHVWGMTETSTVGTVSRPPSGVSGESRWNYRVSQGRFPASLQYRIVNDGQVMASTDRNEGEIQVRGPWVTASYFHPDVEKEGGTASTFRDHDVEEENDELFTADGWLRTGDVGSVTSDGFLTIQDRARDVIRSGGEWIYSAQLENLIVAXEEVVECAVIGFPDDKWVERPLAVTMLYPGIERTRETAERLRDQLRDRLPNWMLPEYWTFVDEVDKTSVGKYDKKDLRNHLRNGDFEVIKLKGPGXK

SEQ ID NO: 67 - DNA, 1401 bp, Corynebacterium glutamicum
  CDS (101)..(1378): RXA01644
gtaggtagaggcttgtggtcactacttgtggccacattttaaaaaaatgcacaagaagagaaagcaaagcattatgagtaacgccgtagcgcaggacctcatgaccatcgccgacatcgtcgaggccacgaccactgcacccatcccattccacatcactgccttcgatggaagcttcactggccctgaagatgctccctaccagctgtttgttgccaacacggatgcagtatcctacatcgcaacagcgccaggagatttgggtttggcacgtgcctacctcatgggagacctcatcgtggaaggtgagcatcccggccatccttatgggatctttgatgcgttgaaggagttctaccgctgcttcaaacgcccagatgcatccaccaccttgcagatcatgtggactctgcggaaaatgaatgccttaaaattccaggaaattccaccaatggaacaagcccctgcatggcgtaaagcactgatcaacgggctagcatccaggcactcgaaatcccgcgacaagaaagccattagctaccactacgacgtgggcaatgagttctactccctgtttttagatgattccatgacctatacctgcgcgtattatccaacgccagaatcaagtttggaagaagcccaagaaaacaaataccgcctcatctttgaaaaactgcgtctgaaagaaggcgatcgcctcctagacgtgggatgcggttggggaggcatggtccgctacgccgccaaacacggtgtgaaagccatcggagttacgctgtctgaacagcaatatgagtggggtcaagcagagatcaaacgccaaggtttggaagacctcgcggaaattcgcttcatggattaccgcgatgttccagaaactggattcgatgcgatctcagcaatcggcatcattgaacacatcggtgtgaacaactatcccgactactttgaattgctcagcagcaaactcaaaacaggcggactgatgctcaaccacagcatcacctacccagacaaccgcccccgccacgcaggtgcatttattgatcgctacattttccccgacggtgaactcactggctctggcaccctgatcaagcacatgcaggacaacggtttcgaagtgctgcacgaagaaaacctccgctttgattaccaacgcaccctgcacgcgtggtgcgaaaacctcaaagaaaattgggaggaagcagttgaactcgccggtgaacccactgcacgactctttggcctgtacatggcaggttcggaatggggatttgcccacaacatcgtccagctgcaccaagtactgggtgtgaaactcgatgagcagggaagtcgcggagaagttcctgaaagaatgtggtggactatctaaagaaacaatgtttcttttta

SEQ ID NO: 68 - protein, 426 aa, Corynebacterium glutamicum
MTIADIVEATTTAPIPFHITAFDGSFTGPEDAPYQLFVANTDAVSYIATAPGDLGLARAYLMGDLIVEGEHPGHPYGIFDALKEFYRCFKRPDASTTLQIMWTLRKMNALKFQEIPPMEQAPAWRKALINGLASRHSKSRDKKAISYHYDVGNEFYSLFLDDSMTYTCAYYPTPESSLEEAQENKYRLIFEKLRLKEGDRLLDVGCGWGGMVRYAAKHGVKAIGVTLSEQQYEWGQAEIKRQGLEDLAEIRFMDYRDVPETGFDAISAIGIIEHIGVNNYPDYFELLSSKLKTGGLMLNHSITYPDNRPRHAGAFIDRYIFPDGELTGSGTLIKHMQDNGFEVLHEENLRFDYQRTLHAWCENLKENWEEAVELAGEPTARLFGLYMAGSEWGFAHNIVQLHQVLGVKLDEQGSRGEVPERMWWTI

SEQ ID NO: 69 - DNA, 1437 bp, Corynebacterium glutamicum
  CDS (101)..(1414): RXA02029
cgcacgtacactacttttagcagttaacccgccgaactttcttgattaagtattcattgagcgttcttggcataaatcccactggaggtgcatcaaacgtatggcagaggcacgtttgcgccatcttgaacccattgatgtggaagagtggcctggggtggcgtcagtgcccaacctagcgtttgctggtgcacgcgcacggcaagcagaatatcgatttgccaaggcctgcagcaacgcaggtttagttctgctaggaaatgacccggatctcattattgatcatgaggaattattctcacgtttggccgcatcgggctggctggggctcgctgagagctacatggcaggcgagtggcgcagcgagaggcttgccgacgtcttgaccgctttgttgggaactgggtttaaaccccgcggcaaactatctggatcgttcaccctgccagggcaagctgtggatgccggaggcgcactacccaatgaactcattcgtttaagttcaggtgatggcatgagcgcatttggtggagtttttgcctccggtgttccaaccactttacgtaccgcagtgaaaagccatgtgccgggagctggtcgcaatagggagcccgcatctcactttgtggatatcaccaagatctcggagcctgtggccgtggagcgtgaagacctcggcgaggctcagcgccgagcagcgtcctttttgcttgacggcgccaaagttaaagccggaagccatgtgttggagtttcccagcagtggtggagctttagctattttggctgctcgacgccagggaactgttgacgctttaacggctgatcccgcgcaagtttcaagcctggaggagacgtttgtgctcgccggtgtggaggaggatattcacatcgaggtcattccccaggcgattccctcgccacgcgaatggggtggcgcctacgattcgatagtcgccatggagaagctagaagtggtgggcaagcacggttccaagcggtttattaaagctatcgacagaatgctcaccaccggcggcaacgtagccatgcaatccttggtagctactgaccaatggagtcctgtgtgttctgaagcgatttctttgctcaaggcctatatttggcctgcgctgcattacccaactgttgatgaagttcatcagcttgttgatagggattcttctctgcgcgtggtgaaggaaacacactttgcgggccattacctaaaaagcgtgcagttgcaacgtgaagtgtttgaaggccagatacgcgaagcggcggcagatggctttgatgccgtctaccgccgcatgtgggtgtatcactacgcgcttattgaagccctgttacgcctgggatgtctcaatgcagtgcaatttgcgttgacgacaagaaacagaagggggcgtcgataagcaaaaatcttttagacctc

SEQ ID NO: 70 - protein, 438 aa, Corynebacterium glutamicum
MAEARLRHLEPIDVEEWPGVASVPNLAFAGARARQAEYRFAKACSNAGLVLLGNDPDLIIDHEELFSRLAASGWLGLAESYMAGEWRSERLADVLTALLGTGFKPRGKLSGSFTLPGQAVDAGGALPNELIRLSSGDGMSAFGGVFASGVPTTLRTAVKSHVPGAGRNREPASHFVDITKISEPVAVEREDLGEAQRRAASFLLDGAKVKAGSHVLEFPSSGGALAILAARRQGTVDALTADPAQVSSLEETFVLAGVEEDIHIEVIPQAIPSPREWGGAYDSIVAMEKLEVVGKHGSKRFIKAIDRMLTTGGNVAMQSLVATDQWSPVCSEAISLLKAYIWPALHYPTVDEVHQLVDRDSSLRVVKETHFAGHYLKSVQLQREVFEGQIREAAADGFDAVYRRMWVYHYALIEALLRLGCLNAVQFALTTRNRRGRR

SEQ ID NO: 71 - DNA, 1140 bp, Corynebacterium glutamicum
  CDS (101)..(1117): RXA01801
tttggattcctttccgattatgtcttgatcgcccattctgtcacatccgggttgtctaaacacccgcgaagatttcctgtgatgtgccacactggttctcatgtctaacgtagtgaacacttttgtccagaattccaccggtatggtggagcttaatcgtcccaaagcgctcaattctcttaatcaggaaatgatcgatctcgttcaggaagctctaaccacttgggctgatgatgatcaggtgcagcaggttctcatttactcatcctcggagcgtgcattttgtgccggcggtgatgtgcgcgcggtccgtgagagcgtgttggagggcgatgttgcggccggcgataagtatttcatcgatgagttcgcgatgaacaacacgttgggaacctatccgaagccggtcatttctgtgatcaacggcgtcgcgatgggtggcggaatgggaatttccatgcatggatcgcaccggatcgtcacggaaaaagcgttcgcgtcgatgcctgagatggcgatcggctatgttcccgatgtgggctttacttatttcggtcagcgtgcatcgtcgctggccatcgccacatttttggcggtgaccgggtggcgcatgagccctgccgatatgctgtgggctggcgtcgcaacgcattttgttgaggatgcgcaggggttcattgatgcggtcttgaacgagtcgcttgatggcgcgctggagaaattctccacgcaacctacgggcagcagcgagctggccggcgtcgccagccagattgaggagacctttgggcacagctcttgggcgcttatcgacgcctccctccggtctcaccccgatgctgaatttgttgccaaggtggatgggctgatggcgtcggcagcaccggcatcggtggtggctaccgtgaagctgatgcatcaaaacagtgaggcgaccactctgcgtgaaggcttggacaatgaattggcgatgtctctttatatgatccgccagcctgattttgctgaaggtgtgcgtgcagtgttggttgataaagaccgcaatgcagccttctccccagccaactacgaagatgttgatgagtcacattttgtgaccttgttccagcgcagttcataaaaccgccaaacttttgatag

SEQ ID NO: 72 - protein, 339 aa, Corynebacterium glutamicum
MSNVVNTFVQNSTGMVELNRPKALNSLNQEMIDLVQEALTTWADDDQVQQVLIYSSSERAFCAGGDVRAVRESVLEGDVAAGDKYFIDEFAMNNTLGTYPKPVISVINGVAMGGGMGISMHGSHRIVTEKAFASMPEMAIGYVPDVGFTYFGQRASSLAIATFLAVTGWRMSPADMLWAGVATHFVEDAQGFIDAVLNESLDGALEKFSTQPTGSSELAGVASQIEETFGHSSWALIDASLRSHPDAEFVAKVDGLMASAAPASVVATVKLMHQNSEATTLREGLDNELAMSLYMIRQPDFAEGVRAVLVDKDRNAAFSPANYEDVDESHFVTLFQRSS

SEQ ID NO: 73 - DNA, 1086 bp, Corynebacterium glutamicum
  CDS (101)..(1063): RXN02512
gctggaaagtccccattggctaaggaatttaccaaggcaccagcaggtgcgaaggcagattacagcaacaccaaataaaaattagccgagggagcatcgcatgaagccgaaggatttctgcacagcggaaaattgggcggagaatttaagcgcactgggctatctagctggttggcgttttgtccggatgctccctttgcctattgctcgccgggtgtttgaccttggggcggatctggcgtcgaaaagcggaaaaggcatggggcagctacgcgctaatctggcgcgggtggtcggtgcggaaaacgttacgcaggcgctggtgaagcaagcaacgcgcagctatgcgcggtattggctggaagcgttccggctaccggcgatcgcgcgagatcctgagctgcttgcgcggttgcgtaagggaactgttggcctagatttgttggatgaatctttggctgccggcaagggcgtagttttgacgctcccacacagcggcaactgggatatggctggcgcttttctgattagccatcatgggcaattcaccaccgttgcagaaagggtcaagccggaacgcttgtttgaagcgttcgtggagtttcgagaaagccttggatttgaggtgctgcctctcaccggtggcgagcgtccgccgtttgaaaagctgaaagagcgcctgacatctggaggtatcgtgtgccttcttggggagcgtgacctgcggcattccggcgtggagaccactttttttggtgagaagacctccatgccagcaggacctgcgcagctggccattgaaacaggtgcggcgctgcacgtggtgcatccatggttcgatgacgacggctggggtctcagcgtatccgatgccgtgaccgtggataatttatccgacacggtgcagcggatcgcacatctttttatggcaaatattacggcgcaccccgctgattggcatatgctccaacccctgtggtttggtgatttggatccggagcgtctcaagcgctctagggagcagacaaatgttcacaaaccggtggcattacaggaggacaattaggtgcgaattggaatggtctg

SEQ ID NO: 74 - protein, 321 aa, Corynebacterium glutamicum
MKPKDFCTAENWAENLSALGYLAGWRFVRMLPLPIARRVFDLGADLASKSGKGMGQLRANLARVVGAENVTQALVKQATRSYARYWLEAFRLPAIARDPELLARLRKGTVGLDLLDESLAAGKGVVLTLPHSGNWDMAGAFLISHHGQFTTVAERVKPERLFEAFVEFRESLGFEVLPLTGGERPPFEKLKERLTSGGIVCLLGERDLRHSGVETTFFGEKTSMPAGPAQLAIETGAALHVVHPWFDDDGWGLSVSDAVTVDNLSDTVQRIAHLFMANITAHPADWHMLQPLWFGDLDPERLKRSREQTNVHKPVALQEDN

SEQ ID NO: 75 - DNA, 1057 bp, Corynebacterium glutamicum
  CDS (101)..(1057): FRXA02512
gctggaaagtccccattggctaaggaatttaccaaggcaccagcaggtgcgaaggcagattacagcaacaccaaataaaaattagccgagggagcatcgcatgaagccgaaggatttctgcacagcggaaaattgggcggagaatttaagcgcactgggctatctagctggttggcgttttgtccggatgctccctttgcctattgctcgccgggtgtttgaccttggggcggatctggcgtcgaaaagcggaaaaggcatggggcagctacgcgctaatctggcgcgggtggtcggtgcggaaaacgttacgcaggcgctggtgaagcaagcaacgcgcagctatgcgcggtattggctggaagcgttccggctaccggcgatcgcgcgagatcctgagctgcttgcgcggttgcgtaagggaactgttggcctagatttgttggatgaatctttggctgccggcaagggcgtagttttgacgctcccacacagcggcaactgggatatggctggcgcttttctgattagccatcatgggcaattcaccaccgttgcagaaagggtcaagccggaacgcttgtttgaagcgttcgtggagtttcgagaaagccttggatttgaggtgctgcctctcaccggtggcgagcgtccgccgtttgaaaagctgaaagagcgcctgacatctggaggtatcgtgtgccttcttggggagcgtgacctgcggcattccggcgtggagaccactttttttggtgagaagacctccatgccagcaggacctgcgcagctggccattgaaacaggtgcggcgctgcacgtggtgcatccatggttcgatgacgacggctggggtctcagcgtatccgatgccgtgaccgtggataatttatccgacacggtgcagcggatcgcacatctttttatggcaaatattacggcgcaccccgctgattggcatatgctccaacccctgtggtttggtgatttggatccggagcgtctcaagcgctctagggagcagacaaatgttcacaaaccggtggcattacaggag

SEQ ID NO: 76 - protein, 319 aa, Corynebacterium glutamicum
MKPKDFCTAENWAENLSALGYLAGWRFVRMLPLPIARRVFDLGADLASKSGKGMGQLRANLARVVGAENVTQALVKQATRSYARYWLEAFRLPAIARDPELLARLRKGTVGLDLLDESLAAGKGVVLTLPHSGNWDMAGAFLISHHGQFTTVAERVKPERLFEAFVEFRESLGFEVLPLTGGERPPFEKLKERLTSGGIVCLLGERDLRHSGVETTFFGEKTSMPAGPAQLAIETGAALHVVHPWFDDDGWGLSVSDAVTVDNLSDTVQRIAHLFMANITAHPADWHMLQPLWFGDLDPERLKRSREQTNVHKPVALQE

SEQ ID NO: 77 - DNA, 1389 bp, Corynebacterium glutamicum
  CDS (101)..(1366): RXA00899
tttgctgctcccctacgtcggactcccactgttcctgcttatgggatcgccatacatcaaccggtgacgccaccgcatccaacaagaaatcaacgacctcatggaagacgtccacgacgacgtccccgacatccccaccggaatggatgtctccgcggaagttgaatctgtcatcaaactcaaccgccgcctcacccgcatgccagcagtgaccggcggaaacaacggcttctactccgactaccgtgaatccctcaaacggatgaccgccgcaatcgacgaagccgaagaatacatctacgtcgagatctacatcatggcctgggattcctacacccaaccattcttcgcagcactcgaacgagcccacaaccgcggcgtcaaagtccgactccttttcgaccacgtcggcagctggaaataccccggctaccaccgcctcaaaaaagaactcaaccgcatgggcttcgcctggtacctcatgctccccctccaaccctggcgacgccgcttccgccgacccgacctgcgcaaccaccgcaaaatgctcatcatcgacggccacaccgcattcatgggctcccaaaatctcatcgccccgagttacctacaaaagaaaaacatcaaactcggccgcgaatggaaagacctcatggtcgaactcaccggccccatcgtctcctccatggaaatgatcttcgccggcgactggtacgtcgaatccaacgaagccctcgacatccgcgaccacgcagaagcccacggctacatcggcaacactcaaaaagactccgccaccaacctcgtgcagctcatcccctccggccctggttacaccacagaacccaacctgcgcatgttcaactccatcgttcaccacgccaaagaacgactcatcttgtgcagcccctacttcatccccgacgaatccctcctcgaagccgtcacctcagcctgctaccgcggagtaaccgtcgaactattcgtctctgaacaagccgaccaattcgccatcgaccacgcccaatcctcctactaccaggcactccttgaagccggcgtgaaaatctaccaattccccaaacccgacgtcctccacaccaagtacatgatcgccgaccccgacgacaccaccggcaacgaagccctcggagtcctcggatcctccaacctcgacatccgcagctttggcctcaactacgaaatctccctgatgatcgccaaaggcaacctcatccacgaactcaacgccctcaccgaccgttaccgcacagtaagtttcaagctcaccttggataagtggaaccagcgcagttggcggcgccgctacgtggacaatgtcatgcgtttgacctcggcgctgcagtagtttggcgcgtttggagtgcg

SEQ ID NO: 78 - protein, 422 aa, Corynebacterium glutamicum
MEDVHDDVPDIPTGMDVSAEVESVIKLNRRLTRMPAVTGGNNGFYSDYRESLKRMTAAIDEAEEYIYVEIYIMAWDSYTQPFFAALERAHNRGVKVRLLFDHVGSWKYPGYHRLKKELNRMGFAWYLMLPLQPWRRRFRRPDLRNHRKMLIIDGHTAFMGSQNLIAPSYLQKKNIKLGREWKDLMVELTGPIVSSMEMIFAGDWYVESNEALDIRDHAEAHGYIGNTQKDSATNLVQLIPSGPGYTTEPNLRMFNSIVHHAKERLILCSPYFIPDESLLEAVTSACYRGVTVELFVSEQADQFAIDHAQSSYYQALLEAGVKIYQFPKPDVLHTKYMIADPDDTTGNEALGVLGSSNLDIRSFGLNYEISLMIAKGNLIHELNALTDRYRTVSFKLTLDKWNQRSWRRRYVDNVMRLTSALQ

SEQ ID NO: 79 - DNA, 1452 bp, Corynebacterium glutamicum
  CDS (101)..(1429): RXN00819
  unsure 1264: n indicates any nucleotide
  unsure 1267: n indicates any nucleotide
  unsure 1268: n indicates any nucleotide
  unsure 1279: n indicates any nucleotide
  unsure 1281: n indicates any nucleotide
  unsure 1285: n indicates any nucleotide
  unsure 1301: n indicates any nucleotide
  unsure 1304: n indicates any nucleotide
  unsure 390: Xaa indicates any amino acid
  unsure 394: Xaa indicates any amino acid
  unsure 401: Xaa indicates any amino acid
  unsure 402: Xaa indicates any amino acid
gatgaggttcgtccgggaatcctcaaagacaatgcggtgaaggtacttggcctagccgctagcactgagcgcggatctcaagcagaaaaggtcgtgcaacatgcgtgatcccattcaaggtgctgttattccttctgatctttttggtttcgcagaagttctcaccgaagccgaacgcgcagttcttctggaaacccgcagggtgcttgaggaagaggtgaagccttatattaatgaggcctgggataaggcagtcttccccgatgagatcgtgcagcccctccaagatctgcaattgcttgatccgcctgcacttcgggaagcaggggagtcggttcgagacattttcactggtttccgcaattttgaactcgcgcgctgtgacatcaatgttggtacctattacaacgcatctgctggtctcttccgaacggcctgcatggttggtggctccccggagcaggcgcagcgattggatgcgcagatcaaatctggtgaggtcaagggcgtttttgcactgacggaacctgatcatggctctgatatcgcaggtggtctggcaaccacggccactaaggacgcagacaccggcgagtggattatcaatggtgaaaaacggtggatcggtggtgcttccactgctgatttgatcgctaccttcgccagggatacagccgataaccaggtgaaatgcttcctcgtggcacctcaggcagagggcgtgtccatggagattattgatcgcaaagcctcactgcgcatcatgcaaaatgcacacattacctataacaatgtccgggtgtctggggatgcgcggctgcacaacatcaattctttcaaggatgtttcggaatgcctgcgccgtatgcgttccgatgtggcgtggatggcggtcggtgcgcaggcaggtgcctatgaagcagccgtgaagtatgtgcgcagcagggaacagtttggccgtccgatcgcggggttccagttgattcaggaaaagctcgcgctcatgctgggcaatctcacggcgtcgctgggcatgatggtcaaactcaccgatcagcagcaggcgggaattttcaaagaggaaaactccgcgctggcgaaaatgtttacctcgctcaaacttcgggagaccgctagttgggcgcgggaaatctgcggaggcaacggcatcattttggacaacgatgttgcccggttccatgccgatgcagaagccgtctattcatatgaaggcacccacgaaatcaatgcactcatcgttggncgnnccattctgggncntctnttctttttatattatnacncttttgaggaggatcttcatgactacttccaccaccccaaaccatcgtttctttcgaagacgcaccaaccctcaccggccaggacctgggcttttcgcagtggcgcactgtcacccaggagatggtgaacaccttggcggacgcaact

SEQ ID NO: 80 - protein, 443 aa, Corynebacterium glutamicum
  unsure 390: Xaa indicates any amino acid
  unsure 394: Xaa indicates any amino acid
  unsure 401: Xaa indicates any amino acid
  unsure 402: Xaa indicates any amino acid
MRDPIQGAVIPSDLFGFAEVLTEAERAVLLETRRVLEEEVKPYINEAWDKAVFPDEIVQPLQDLQLLDPPALREAGESVRDIFTGFRNFELARCDINVGTYYNASAGLFRTACMVGGSPEQAQRLDAQIKSGEVKGVFALTEPDHGSDIAGGLATTATKDADTGEWIINGEKRWIGGASTADLIATFARDTADNQVKCFLVAPQAEGVSMEIIDRKASLRIMQNAHITYNNVRVSGDARLHNINSFKDVSECLRRMRSDVAWMAVGAQAGAYEAAVKYVRSREQFGRPIAGFQLIQEKLALMLGNLTASLGMMVKLTDQQQAGIFKEENSALAKMFTSLKLRETASWAREICGGNGIILDNDVARFHADAEAVYSYEGTHEINALIVGRXILGXLFFLYYXXFEEDLHDYFHHPKPSFLSKTHQPSPARTWAFRSGALSPRRW

SEQ ID NO: 81 - DNA, 1030 bp, Corynebacterium glutamicum
  CDS (18)..(1007): FRXA00819
  unsure 842: n indicates any nucleotide
  unsure 845: n indicates any nucleotide
  unsure 846: n indicates any nucleotide
  unsure 857: n indicates any nucleotide
  unsure 859: n indicates any nucleotide
  unsure 863: n indicates any nucleotide
  unsure 879: n indicates any nucleotide
  unsure 882: n indicates any nucleotide
  unsure 277: Xaa indicates any amino acid
  unsure 281: Xaa indicates any amino acid
  unsure 288: Xaa indicates any amino acid
  unsure 289: Xaa indicates any amino acid
tcttccgaacggcctgcatggttggtggctccccggagcaggcgcagcgattggatgcgcagatcaaatctggtgaggtcaagggcgtttttgcactgacggaacctgatcatggctctgatatcgcaggtggtctggcaaccacggccactaaggacgcagacaccggcgagtggattatcaatggtgaaaaacggtggatcggtggtgcttccactgctgatttgatcgctaccttcgccagggatacagccgataaccaggtgaaatgcttcctcgtggcacctcaggcagagggcgtgtccatggagattattgatcgcaaagcctcactgcgcatcatgcaaaatgcacacattacctataacaatgtccgggtgtctggggatgcgcggctgcacaacatcaattctttcaaggatgtttcggaatgcctgcgccgtatgcgttccgatgtggcgtggatggcggtcggtgcgcaggcaggtgcctatgaagcagccgtgaagtatgtgcgcagcagggaacagtttggccgtccgatcgcggggttccagttgattcaggaaaagctcgcgctcatgctgggcaatctcacggcgtcgctgggcatgatggtcaaactcaccgatcagcagcaggcgggaattttcaaagaggaaaactccgcgctggcgaaaatgtttacctcgctcaaacttcgggagaccgctagttgggcgcgggaaatctgcggaggcaacggcatcattttggacaacgatgttgcccggttccatgccgatgcagaagccgtctattcatatgaaggcacccacgaaatcaatgcactcatcgttggncgnnccattctgggncntctnttctttttatattatnacncttttgaggaggatcttcatgactacttccaccaccccaaaccatcgtttctttcgaagacgcaccaaccctcaccggccaggacctgggcttttcgcagtggcgcactgtcacccaggagatggtgaacaccttcgcggacgcaact

SEQ ID NO: 82 - protein, 330 aa, Corynebacterium glutamicum
  unsure 277: Xaa indicates any amino acid
  unsure 281: Xaa indicates any amino acid
  unsure 288: Xaa indicates any amino acid
  unsure 289: Xaa indicates any amino acid
MVGGSPEQAQRLDAQIKSGEVKGVFALTEPDHGSDIAGGLATTATKDADTGEWIINGEKRWIGGASTADLIATFARDTADNQVKCFLVAPQAEGVSMEIIDRKASLRIMQNAHITYNNVRVSGDARLHNINSFKDVSECLRRMRSDVAWMAVGAQAGAYEAAVKYVRSREQFGRPIAGFQLIQEKLALMLGNLTASLGMMVKLTDQQQAGIFKEENSALAKMFTSLKLRETASWAREICGGNGIILDNDVARFHADAEAVYSYEGTHEINALIVGRXILGXLFFLYYXXFEEDLHDYFHHPKPSFLSKTHQPSPARTWAFRSGALSPRRW

SEQ ID NO: 83 - DNA, 391 bp, Corynebacterium glutamicum
  CDS (101)..(391): FRXA01766
gatgaggttcgtccgggaatcctcaaagacaatgcggtgaaggtacttggcctagccgctagcactgagcgcggatctcaagcagaaaaggtcgtgcaacatgcgtgatcccattcaaggtgctgttattccttctgatctttttggtttcgcagaagttctcaccgaagccgaacgcgcagttcttctggaaacccgcagggtgcttgaggaagaggtgaagccttatattaatgaggcctgggataaggcagtcttccccgatgagatcgtgcagcccctccaagatctgcaattgcttgatccgcctgcacttcgggaagcaggggagtcggttcgagacattttcactggtttccgcaattttgaactcgcgcgctgtgacatcaat

SEQ ID NO: 84 - protein, 97 aa, Corynebacterium glutamicum
MRDPIQGAVIPSDLFGFAEVLTEAERAVLLETRRVLEEEVKPYINEAWDKAVFPDEIVQPLQDLQLLDPPALREAGESVRDIFTGFRNFELARCDIN

SEQ ID NO: 85 - DNA, 1659 bp, Corynebacterium glutamicum
  CDS (101)..(1636): RXN01762
tggagtgatgaattttcctatagaacgttttttaaacgattgactttttaaacgtttacgcttttaatgacttcaaacgtgatctaaagcacaaaggagaatgaaagtgaacctcggaataggaagctacccacgacgcagggcaactgttcgaccagagtccactgcaatcgaattcgaaggcaccagcatcacctacggagaattcagcaaacgagtcaatcggcttggacatgctcttctagacctcggcgttgcgcaccaagatcgagtagcttatgtcggattcaaccaccctgccctgctagaagtgttcttttcaacgaacctcattggggcaacacccgtgcttgttaaccctcgcctatcggcaaacgaaatcgattacatcatccaagacagcggtgcgagcatcgtgttttacggaatcgacctcatcgagcacgccacttacctccaagaactccatccagagatcatcatggtggccgttgaaggcgatgagggtccaggtttgcgtcgaaaagcgcttattgaagcggcgagcgacgccgacatcgacctagaagtcagcgatgatgacctggtgctgctcatgtacacctccggaaccactggccgcccaaagggcgccatgttatcccaccgaaacctcttctttaactacttcaatgccctgctcagccaggaaattgaacaaggcgcggtacttttatccactgcgccgttattccacatcgcgggcctcaacatgaccaccatcccggtgatgatgaagggcggaaaggtgatcatccaccgcgaattccgggcagagcacgtcctcgacgaaatcgaacgctccaaggtatccgaatccttcatggtgccagcgatgatcgacatgttgtccaaccacccatcatttgccgaacgcgacctttcttcccttcgcgccatcatggtgggcggctctccccttagcgaacgtgcgctgcgaatctggcaaggacgcgacgtaaaaattgtccaaggcttcggcatgacagaaaccgcaccgggcgcctgtatcctcgaggcaacagacacaagcacacaccttggaaccgcaggtcgagcccacttcttcaccgacatcaaactagtggacccgaaaaccggcgaagaagtccccaccggagaggccggcgaagttctcatccgcggaccacatgtgatgaccggatactggaaccgaccagaagacaccgccagcgcactacaaaatggctggtaccactccggagatatcgccatcaaagatgaagacggctactacaccatcaaagaccgcatcaaagacatgtacatctccggcggcgaaaacatttaccccgcagaagtcgaacaagcactccaggaactggaagcagtccttgatgccgcagtcatcggagtccccgatgaacgatggggcgaaactggcatcgcctttgtctccatccgagaaagctacctgaccaacccaccaaccggaccggaactacgagaactactaggcagtgtcctagccagatacaaacttccacgagaaatccacatcatcgaagaactcccccgcaacgccacaggcaaaatccaaaagaacatcctgcgagacttcaccatccccgtttcataaaccccccaacgtcactttga

SEQ ID NO: 86 - protein, 512 aa, Corynebacterium glutamicum
MKVNLGIGSYPRRRATVRPESTAIEFEGTSITYGEFSKRVNRLGHALLDLGVAHQDRVAYVGFNHPALLEVFFSTNLIGATPVLVNPRLSANEIDYIIQDSGASIVFYGIDLIEHATYLQELHPEIIMVAVEGDEGPGLRRKALIEAASDADIDLEVSDDDLVLLMYTSGTTGRPKGAMLSHRNLFFNYFNALLSQEIEQGAVLLSTAPLFHIAGLNMTTIPVMMKGGKVIIHREFRAEHVLDEIERSKVSESFMVPAMIDMLSNHPSFAERDLSSLRAIMVGGSPLSERALRIWQGRDVKIVQGFGMTETAPGACILEATDTSTHLGTAGRAHFFTDIKLVDPKTGEEVPTGEAGEVLIRGPHVMTGYWNRPEDTASALQNGWYHSGDIAIKDEDGYYTIKDRIKDMYISGGENIYPAEVEQALQELEAVLDAAVIGVPDERWGETGIAFVSIRESYLTNPPTGPELRELLGSVLARYKLPREIHIIEELPRNATGKIQKNILRDFTIPVS

SEQ ID NO: 87 - DNA, 1372 bp, Corynebacterium glutamicum
  CDS (101)..(1363): FRXA01762
tggagtgatgaattttcctatagaacgttttttaaacgattgactttttaaacgtttacgcttttaatgacttcaaacgtgatctaaagcacaaaggagaatgaaagtgaacctcggaataggaagctacccacgacgcagggcaactgttcgaccagagtccactgcaatcgaattcgaaggcaccagcatcacctacggagaattcagcaaacgagtcaatcggcttggacatgctcttctagacctcggcgttgcgcaccaagatcgagtagcttatgtcggattcaaccaccctgccctgctagaagtgttcttttcaacgaacctcattggggcaacacccgtgcttgttaaccctcgcctatcggcaaacgaaatcgattacatcatccaagacagcggtgcgagcatcgtgttttacggaatcgacctcatcgagcacgccacttacctccaagaactccatccagagatcatcatggtggccgttgaaggcgatgagggtccaggtttgcgtcgaaaagcgcttattgaagcggcgagcgacgccgacatcgacctagaagtcagcgatgatgacctggtgctgctcatgtacacctccggaaccactggccgcccaaagggcgccatgttatcccaccgaaacctcttctttaactacttcaatgccctgctcagccaggaaattgaacaaggcgcggtacttttatccactgcgccgttattccacatcgcgggcctcaacatgaccaccatcccggtgatgatgaagggcggaaaggtgatcatccaccgcgaattccgggcagagcacgtcctcgacgaaatcgaacgctccaaggtatccgaatccttcatggtgccagcgatgatcgacatgttgtccaaccacccatcatttgccgaacgcgacctttcttcccttcgcgccatcatggtgggcggctctccccttagcgaacgtgcgctgcgaatctggcaaggacgcgacgtaaaaattgtccaaggcttcggcatgacagaaaccgcaccgggcgcctgtatcctcgaggcaacagacacaagcacacaccttggaaccgcaggtcgagcccacttcttcaccgacatcaaactagtggacccgaaaaccggcgaagaagtccccaccggagaggccggcgaagttctcatccgcggaccacatgtgatgaccggatactggaaccgaccagaagacaccgccagcgcactacaaaatggctggtaccactccggagatatcgccatcaaagatgaagacggctactacaccatcaaagaccgcatcaaagacatgtacatctccggcggcgaaaacatttaccccgcagaagtctaagtaccc

SEQ ID NO: 88 - protein, 421 aa, Corynebacterium glutamicum
MKVNLGIGSYPRRRATVRPESTAIEFEGTSITYGEFSKRVNRLGHALLDLGVAHQDRVAYVGFNHPALLEVFFSTNLIGATPVLVNPRLSANEIDYIIQDSGASIVFYGIDLIEHATYLQELHPEIIMVAVEGDEGPGLRRKALIEAASDADIDLEVSDDDLVLLMYTSGTTGRPKGAMLSHRNLFFNYFNALLSQEIEQGAVLLSTAPLFHIAGLNMTTIPVMMKGGKVIIHREFRAEHVLDEIERSKVSESFMVPAMIDMLSNHPSFAERDLSSLRAIMVGGSPLSERALRIWQGRDVKIVQGFGMTETAPGACILEATDTSTHLGTAGRAHFFTDIKLVDPKTGEEVPTGEAGEVLIRGPHVMTGYWNRPEDTASALQNGWYHSGDIAIKDEDGYYTIKDRIKDMYISGGENIYPAEV

SEQ ID NO: 89 - DNA, 867 bp, Corynebacterium glutamicum
  CDS (101)..(844): RXA00681
aagggcaaggttgtcattgttgatccagatgcgccacgcatcgaaggacccggcgcgcacagccatgcgcactcagtagcagcacatggggtggatacacatgcctagtccacgcactgttcttatcactggtgccgctggcggtttgggtcgggcattcgctgaaggtttcgcagcccaaggagaccgtatcgcggtggcggatatcaatctggatggggcgcaagagaccgttgacaagctgaaagcattgggcgcagatgccgcagcctttgaagttgatgtcacgtctttggagtccaccgaggccctagccgccggtgccgctgagtttggcggtggccgaattgatgtccttattaataacgcagcgatatatgcgacagtgactcgttcaccgtttgaggatattgaccctgcggagtgggatttggtcatgggagtcaatctcaaaggcccgtggttggtgacgcgttctgtgagtccgtttttgtccgataatgcccgtgtggtcaatctttccagcgcgactgtgttttcaggatctgcacactgggcgcactacgtggcatccaaaggtggggtcattgctttaaccagggtgcttgctaaagagctgggtggtcgtgggatcacggtcaatgcggttgcgcctgggtttacgctgactgaagccagcttgggactcatggatagcgcggaaacgtacggtgtcgatcgcggatccatcaagcgcgcaagccaaccgaaagacatcgtcggcaccaccatgtttcttgcatccccagaagccgaatacatcactgggcaaacactcatcgttgatggtggccgacagttcatctaagtactaaaagttctaaggag

SEQ ID NO: 90 - protein, 248 aa, Corynebacterium glutamicum
MPSPRTVLITGAAGGLGRAFAEGFAAQGDRIAVADINLDGAQETVDKLKALGADAAAFEVDVTSLESTEALAAGAAEFGGGRIDVLINNAAIYATVTRSPFEDIDPAEWDLVMGVNLKGPWLVTRSVSPFLSDNARVVNLSSATVFSGSAHWAHYVASKGGVIALTRVLAKELGGRGITVNAVAPGFTLTEASLGLMDSAETYGVDRGSIKRASQPKDIVGTTMFLASPEAEYITGQTLIVDGGRQFI

SEQ ID NO: 91 - DNA, 837 bp, Corynebacterium glutamicum
  CDS (101)..(814): RXA00802
gccatggtgatcacaccagtgtgggggctgaggctccacacttggaggaatggattaaacgcgggcactaagccccgaacgattagtaggcttgggcaccatggatcttaaacttggtggccaagtcatacttgttgttggcggtgcaggaactattggttctgaagttgtaaaactcttaactgaagaaggcgcaaccgcggtagcggcgtcgagaagcacgcccttatctattgacgcttcggatgaagcgtccgtccgtgcgggcattgatcaggtgatcgcagaacatggtcgcctggatgggctggttgtttcttctgcacccgctgcgcaaacgctcagcgcggagacagcagatgatccggacactgtgttggctgctattgaaggcaaagccatcacgtttatgaaggctgcaaccgtggcgctcgagaagatgcgtgaggctggacatgggcgcatcgttgcactttccggcatgaactcatacaaaacattgagtactactgcgtcggcgcgaaatgctgcgctgaatgtcgtggtgaaaaatttggcggatcgtcacgcgggcaccggaattacagtaaatgcgattagcccgggattcgtggtagctgagccagacgctgaggtaaaccgcgcaaatggtgacaccacgtggaggaggtcgcggaggcgatcgcgtttttgttgtcgccgcgcaccgcatcaatttctggagagattatttcggtgggacataaggcgaagggcatcatccttccttagctcgcgtgagcttcccaagcgtaagcacccccgtgtgagggcataacggccgttctgttaaagatt

SEQ ID NO: 92 - protein, 238 aa, Corynebacterium glutamicum
MDLKLGGQVILVVGGAGTIGSEVVKLLTEEGATAVAASRSTPLSIDASDEASVRAGIDQVIAEHGRLDGLVVSSAPAAQTLSAETADDPDTVLAAIEGKAITFMKAATVALEKMREAGHGRIVALSGMNSYKTLSTTASARNAALNVVVKNLADRHAGTGITVNAISPGFVVAEPDAEVNRANGDTTWRRSRRRSRFCCRRAPHQFLERLFRWDIRRRASSFLSSRELPKRKHPRVRA

SEQ ID NO: 93 - DNA, 329 bp, Corynebacterium glutamicum
  CDS (1)..(306): RXA02133
gaaaacccctacattggcggagctggatacaacgcagcaaaattcggtgtagcagcattcaaccgtgtgcttcgcttggaaacccaccagcagacccttcgcgtatctgagatcgatccaggtcgagttgccacggaagaattctccctcgttcgtttcggcggagataaagaacgcgcagaagcagtctatgacgacgtcctcaacctcaccgctgaagacatcgcagagtctgtgcgttgggtcgcgagccttccaaagcacatgaacattgaccgcatgcgtattacacctcgcgatcaggtctaaaacccgcactcttttgaaat

SEQ ID NO: 94 - protein, 102 aa, Corynebacterium glutamicum
ENPYIGGAGYNAAKFGVAAFNRVLRLETHQQTLRVSEIDPGRVATEEFSLVRFGGDKERAEAVYDDVLNLTAEDIAESVRWVASLPKHMNIDRMRITPRDQV

SEQ ID NO: 95 - DNA, 1347 bp, Corynebacterium glutamicum
  CDS (101)..(1324): RXN01114
ttcggtggaagatatccgcaagctggtgctgccgcagcttttagaaacggctcaagcaatttcgacagatctctctgcactctaaattaaggatcaaaaaatgaaccctcaagatattgtcatctgttccccattgcgcaccccagttggtgcttacggcggatccttcaccggcgtccctgttgaagaattggccaccaccgtgatcaacgcgatcgttgaggcaaccggcatcaccggcgacgatgtggacgatctgatcctcggccaggcatcccccaacggtgcggctccagcactgggccgtgttgttgctctagattccaagcttggccaaaacgttccaggcatgcagcttgatcgccgctgtggttccggcctgcaggcaatcgtcaccgctgctgcacacgttgcatccggcgctgctgatctgatcatcgcaggtggcgcagaatccatgagccgcgttgagtacaccgtgtccggcgatatccgttggggtgtcaagggcggcgacatgcagcttcgtgaccgccttgcagaagcacgcgaaaccgctggcggacgcaaccacccgatccctggtggcatgatcgagaccgctgagaacctgcgtcgcgaatacggcatctcccgcgaggagcaggacaagatctccgcagcgtcccagcagcgttggggcaaggctgctgatgcggggcttttcgacgacgagatcgtgccagtcaccgtccctgccaagaagcgcggccaggagccaaccatcgtttctcgagacgagcatggtcgaccaggaacaaccgtcgaaaagcttgctgctttgcgccccatcatgggccgccaggatgcggaagcaaccgtcaccgctggcaacgcgtccggccaaaatgatggcgctgctgccgtcatcgtgaccactcgcgccaaggccgaggagaagggcctgcgcccagtcatgcgtttggctggctggtctgtggctgctgttcccccagagaccatgggtattggacctgttcctgccaccaagaaggtcctggatcgtttgggccttaccctggaggacatcggcgcgatcgaactcaacgaagctttcgcagctcaggcactgtctgtgctgaaggaatggaacatttcttgggaagatgagcgcgtcaacccactgggttccggtatttccatgggacacccagtcggtgccaccggtgctcgcatggcagtaaccttggctcaccgcatgcagcgtgaaaacactcagtacggactggccaccatgtgcatcggtggcggccagggtcttgcagctgtctttgaaaaggagaactaaaaatggctattttgcacagc

SEQ ID NO: 96 - protein, 408 aa, Corynebacterium glutamicum
MNPQDIVICSPLRTPVGAYGGSFTGVPVEELATTVINAIVEATGITGDDVDDLILGQASPNGAAPALGRVVALDSKLGQNVPGMQLDRRCGSGLQAIVTAAAHVASGAADLIIAGGAESMSRVEYTVSGDIRWGVKGGDMQLRDRLAEARETAGGRNHPIPGGMIETAENLRREYGISREEQDKISAASQQRWGKAADAGLFDDEIVPVTVPAKKRGQEPTIVSRDEHGRPGTTVEKLAALRPIMGRQDAEATVTAGNASGQNDGAAAVIVTTRAKAEEKGLRPVMRLAGWSVAAVPPETMGIGPVPATKKVLDRLGLTLEDIGAIELNEAFAAQALSVLKEWNISWEDERVNPLGSGISMGHPVGATGARMAVTLAHRMQRENTQYGLATMCIGGGQGLAAVFEKEN

SEQ ID NO: 97 - DNA, 815 bp, Corynebacterium glutamicum
  CDS (1)..(792): FRXA01114
cgccttgcagaagcacgcgaaaccgctggcggacgcaaccacccgatccctggtggcatgatcgagaccgctgagaacctgcgtcgcgaatacggcatctcccgcgaggagcaggacaagatctccgcagcgtcccagcagcgttggggcaaggctgctgatgcggggcttttcgacgacgagatcgtgccagtcaccgtccctgccaagaagcgcggccaggagccaaccatcgtttctcgagacgagcatggtcgaccaggaacaaccgtcgaaaagcttgctgctttgcgccccatcatgggccgccaggatgcggaagcaaccgtcaccgctggcaacgcgtccggccaaaatgatggcgctgctgccgtcatcgtgaccactcgcgccaaggccgaggagaagggcctgcgcccagtcatgcgtttggctggctggtctgtggctgctgttcccccagagaccatgggtattggacctgttcctgccaccaagaaggtcctggatcgtttgggccttaccctggaggacatcggcgcgatcgaactcaacgaagctttcgcagctcaggcactgtctgtgctgaaggaatggaacatttcttgggaagatgagcgcgtcaacccactgggttccggtatttccatgggacacccagtcggtgccaccggtgctcgcatggcagtaaccttggctcaccgcatgcagcgtgaaaacactcagtacggactggccaccatgtgcatcggtggcggccagggtcttgcagctgtctttgaaaaggagaactaaaaatggctattttgcacagc

SEQ ID NO: 98 - protein, 264 aa, Corynebacterium glutamicum
RLAEARETAGGRNHPIPGGMIETAENLRREYGISREEQDKISAASQQRWGKAADAGLFDDEIVPVTVPAKKRGQEPTIVSRDEHGRPGTTVEKLAALRPIMGRQDAEATVTAGNASGQNDGAAAVIVTTRAKAEEKGLRPVMRLAGWSVAAVPPETMGIGPVPATKKVLDRLGLTLEDIGAIELNEAFAAQALSVLKEWNISWEDERVNPLGSGISMGHPVGATGARMAVTLAHRMQRENTQYGLATMCIGGGQGLAAVFEKEN

SEQ ID NO: 99 - DNA, 978 bp, Corynebacterium glutamicum
  CDS (101)..(955): RXA01894
agaattttttcgaaaatgctggcaccatcaacagtgacattgttagaaacttcaaggagaacccatgaatgaaccggagcaacatcaccggtccatgaggatgcccaaacccaaaaataatgcgggtcgagatctcaaagctgccattgctgtggggatcggactgggggtcctggttcttttggggattgtcctaagcccatggggttggtacatcctcgttgcaggttttatggctgcagcaacatgggaagttggtagcagacttaaagaaggcggctatcatttgccactgccgattatgatcatcggcggtcaggcaatcatctggctgtcatggccatttggcacgatgggcattttggcgtcttttgtggccactgtgttggtgctgatgtatttccgaattttctacaatggcacggaaaaagaagcccgcaactatttgagggacacctctgtgggcatcttcgtgctcacctggattccattgttcggaagcttcgctgcgatgctgtcgctgatgcaaaacaattccatcccgggtacatatttcattttgacgttcatgctgtgtgtgatcgcatcggatgtgggcgggtatatcgcgggtgtgttctttggatcgcacccaatggcgccgttggtgagtccgaagaagtcttgggaaggctttgccggctccattgtcttaggatcggtcactggtgcactcagtgttcacttcctgctcgatcaccactggtggatgggtgtgatcttgggttgtgccctagttgtgtgcgccacgttgggtgacttggttgagtcgcagttcaaacgcgatttgggcatcaaggatatgtcgaaccttcttccaggccacggcggattgatggaccgtttggatggcatgctcccggccgcgatggtgacgtggttgatcctgagtgtgatcagcagctcgtatccgtcgtaaagcttgggccagctttaagt

SEQ ID NO: 100 - protein, 285 aa, Corynebacterium glutamicum
MPKPKNNAGRDLKAAIAVGIGLGVLVLLGIVLSPWGWYILVAGFMAAATWEVGSRLKEGGYHLPLPIMIIGGQAIIWLSWPFGTMGILASFVATVLVLMYFRIFYNGTEKEARNYLRDTSVGIFVLTWIPLFGSFAAMLSLMQNNSIPGTYFILTFMLCVIASDVGGYIAGVFFGSHPMAPLVSPKKSWEGFAGSIVLGSVTGALSVHFLLDHHWWMGVILGCALVVCATLGDLVESQFKRDLGIKDMSNLLPGHGGLMDRLDGMLPAAMVTWLILSVISSSYPS

SEQ ID NO: 101 - DNA, 600 bp, Corynebacterium glutamicum
  CDS (101)..(577): RXA02599
gatcaagcatcatacgatgtcggagattgtggcgggcgttgttacaggagcagttgcaaccggcatttgttatgcactcctacttgcgtaaaggagaattatggatcagctaatcctcgacgcatttatcggcttgagagtgacttggctgagtccggtgattattttgttcacccagctcaccgggccaacactgatgtttgtgtatgcgcttgtgtggggcttgttgcgcaagagcgccactgccccgatcgcggtggggctggctaatctgatcagtcattttctcaagagggcgtttgaacggcctcgaccaaatacagcagagcacttggttgtagaaactaacttttcattcccttctggtcatgctgtgggcgctgcagcatgtgccgtggcagtggggtactccgtgaaccggtggtggaaactcacgctgtgggtaatcgcgctgcttgtggggctgtctcggttgtatgtcggtgtgcattggcccagcgatgtgcttgccggctgggccatcggtgcgttgacttcagtggtggtgtttaccagctggaacctcctccagcgccgctgaaaccactgctgaaagtggta

SEQ ID NO: 102 - protein, 159 aa, Corynebacterium glutamicum
MDQLILDAFIGLRVTWLSPVIILFTQLTGPTLMFVYALVWGLLRKSATAPIAVGLANLISHFLKRAFERPRPNTAEHLVVETNFSFPSGHAVGAAACAVAVGYSVNRWWKLTLWVIALLVGLSRLYVGVHWPSDVLAGWAIGALTSVVVFTSWNLLQRR

SEQ ID NO: 103 - DNA, 999 bp, Corynebacterium glutamicum
  CDS (101)..(976): RXN02638
ctctgttgttgttcctgaggcgcttcgtccattcgtgggcaaagacgtgctcaagccagtgaaacaagccggttaattaagcggaaagctcgtggtcgacatggtcaaaaggtttggctttttcgtagaggattccctgcctaaggttccgctgcatcccgaagagtcacgggagacgttttatgggcgcatcatcattagtgctgtgcggacggtgatgaaagcccaggatgtgcagatttccatcttcggtgcggagaacattccgaccaccggcggcgcacttttcgcatcaaccacactggttattatgacttcattctgggtggtatcccccgcattcgtgcggggtaagcgcctggttcgattcatggcgaagaaggaaattttcgacaccccagttgtcggcaccctcatgcgctggatgaagcacgtctctgtggaccgctccgcaggtgccggttccatggaagatgcgcggaagcgtctcgacgccggcagcctcgtcggtatcttccctgaggcgacggtgtcacggtcctttgaaatcaaggaactaaaaactggcgccgtccgcatcgccgacagcgctaacgttccgctgctgccacttattatttggggcggccagcgcatcatcaccaaagacatcgagcgcgacttcggccgctcccacatccccgtattcatcagcgtgggtgaacccgtcgacgccagcggcgatcccgacgaagcaacggaacgcctctacgaggctatgaaaaagcttctcgacgaaacccgcaccgcctacgaacaaaagtatggcccattcgaaggtggagaattgtggcgcccgaaatccctcggcggcggcgccccaacgttggagcaggcgaaaatgttggaaatcgccgaacgggaacgtcgacaagcaaaacgcgcggcaaaggtcgccaagaaacgcaccacctttataaggaaaatctttaaaaaatgattgcactgggttcagcgccc

SEQ ID NO: 104 - protein, 292 aa, Corynebacterium glutamicum
MVKRFGFFVEDSLPKVPLHPEESRETFYGRIIISAVRTVMKAQDVQISIFGAENIPTTGGALFASTTLVIMTSFWVVSPAFVRGKRLVRFMAKKEIFDTPVVGTLMRWMKHVSVDRSAGAGSMEDARKRLDAGSLVGIFPEATVSRSFEIKELKTGAVRIADSANVPLLPLIIWGGQRIITKDIERDFGRSHIPVFISVGEPVDASGDPDEATERLYEAMKKLLDETRTAYEQKYGPFEGGELWRPKSLGGGAPTLEQAKMLEIAERERRQAKRAAKVAKKRTTFIRKIFKK

SEQ ID NO: 105 - DNA, 534 bp, Corynebacterium glutamicum
  CDS (8)..(511): FRXA02638
atgaagaatggcgcggaagcgtcttaacgccggcagcctcgtcggtatcttccctgaggcgacggtgtcacggtcctttgaaatcaaggaactaaaaactggcgccgtccgcatcgccgacagcgctaacgttccgctgctgccacttattatttggggcggccagcgcatcatcaccaaagacatcgagcgcgacttcggccgctcccacatccccgtattcatcagcgtgggtgaacccgtcgacgccagcggcgatcccgacgaagcaacggaacgcctctacgaggctatgaaaaagcttctcgacgaaacccgcaccgcctacgaacaaaagtatggcccattcgaaggtggagaattgtggcgcccgaaatccctcggcggcggcgccccaacgttggagcaggcgaaaatgttggaaatcgccgaacgggaacgtcgacaagcaaaacgcgcggcaaaggtcgccaagaaacgcaccacctttataaggaaaatctttaaaaaatgattgcactgggttcagcgccc

SEQ ID NO: 106 - protein, 168 aa, Corynebacterium glutamicum
MARKRLNAGSLVGIFPEATVSRSFEIKELKTGAVRIADSANVPLLPLIIWGGQRIITKDIERDFGRSHIPVFISVGEPVDASGDPDEATERLYEAMKKLLDETRTAYEQKYGPFEGGELWRPKSLGGGAPTLEQAKMLEIAERERRQAKRAAKVAKKRTTFIRKIFKK

SEQ ID NO: 107 - DNA, 637 bp, Corynebacterium glutamicum
  CDS (101)..(637): RXA00856
gtttttaggaatagagtgggctcaagctttgtgacaagttttttggagaaatcattactagtcgtagtcttcaatttgggtgcaggtagggtggaacaccgtgagtgatgtatcagcaggcgtaaatggcgcacaagatccaagcaatcaagcggtcaagccttccaactggaaccttccgaacttcttgaccagcttgcgtatcattgtcatccctttgtttgcgtggcttacgcttaaaggtgagacggaaaacaatgcttttgcctggtgggcgttggttgttttcattttgctcatgatcaccgacaagcttgacggcgatattgcgcgagcacgtggcctggtcactgactttggcaagatcgcggatccgattgccgataaggcgttgatgaccacagcatttgtctgtttcaacatcatcggcattttgccctggtgggtcactgcgttgattgtgcttcgagagttcggcattaccatctggcgtttcttccaactgcgcgctggaaatgttgtgcctgcatcaaaggggggcaagcttaagactgctctgcagactgttgccgttgctctgtatctgtgccctttcccaagttggatggatattccaagccagatcgtcatgtatgca

SEQ ID NO: 108 - protein, 179 aa, Corynebacterium glutamicum
VSDVSAGVNGAQDPSNQAVKPSNWNLPNFLTSLRIIVIPLFAWLTLKGETENNAFAWWALVVFILLMITDKLDGDIARARGLVTDFGKIADPIADKALMTTAFVCFNIIGILPWWVTALIVLREFGITIWRFFQLRAGNVVPASKGGKLKTALQTVAVALYLCPFPSWMDIPSQIVMYA

SEQ ID NO: 109 - DNA, 780 bp, Corynebacterium glutamicum
  CDS (101)..(757): RXA02511
ccatgcttgcgcaagcatggggcaccattgatggggcaccaggcactgtcgacccaacgctgacttcagcgatccgtaccgcagcaccgaaggagcactgatgctgggacttcatggacgtaagcctgcgcaggttattgttgagcctgttgccaaattgatgatcaagttgaaggtgacgcctaatcagctcaccttagtcagcgctggcctcaccgttggggtggctttgctgctgattcctacggggcatttgatttgggcggcagttttgacgggcctgtttgcggctttcgacatgattgatggcacggttgctcgcatgcaaggtggtggcaccaaatttggtgccaccttggatgccacgtgtgaccgcatcactgatggtgcactatttggtgcgattacctggtggctggtgtattcctacgatgcaccacaggcattggtcgctgcctccttggtttgtttggttgcctcccaggtgatctcttacgtgaaagccaggggagaggcctccggattcaccatggacggcggtctcgtggaacgccctgagcgtctgattgtcagccttgttggtttggggctgaccggaatgggcgttccatatgccatcgatgtggcactgtgggcccttgcagctggcagtatttacactgttgtgcagcgcttggtcatggctggaaagtccccattggctaaggaatttaccaaggcaccagcaggtgcgaaggcagattacagcaacaccaaataaaaattagccgagggagcatc

SEQ ID NO: 110 - protein, 219 aa, Corynebacterium glutamicum
MLGLHGRKPAQVIVEPVAKLMIKLKVTPNQLTLVSAGLTVGVALLLIPTGHLIWAAVLTGLFAAFDMIDGTVARMQGGGTKFGATLDATCDRITDGALFGAITWWLVYSYDAPQALVAASLVCLVASQVISYVKARGEASGFTMDGGLVERPERLIVSLVGLGLTGMGVPYAIDVALWALAAGSIYTVVQRLVMAGKSPLAKEFTKAPAGAKADYSNTK

SEQ ID NO: 111 - DNA, 678 bp, Corynebacterium glutamicum
  CDS (101)..(655): RXN02836
ccatcactcggcttcaccgtctacggtgctgcccgcaggacagagcgcccccaaaagctcgcttcagacgggatccaccccctcgagatggacgtcaccgatgacaatcgatgaaggccgtcgccagttcgaggtcaatgtattcggcgcgatggccctcacccgactcgtcctgccccacatgcagaaacaaaagtgggggacgatcgtgaacatcacatcgatgggcgggaagatctacacgcctctcggcggctggtatcacggcaccaagttcgccctcgaggccctctcggacgccctccgcctggaggtcgccccattcggcatcgacgttgttgtcatcgaaccgggcggcatcgccaccgagtggggaggaatcgctgccgacaatctcgacgcagtgtcgaaagacagcgcatacaagcgccaggctgacgcagtatcgaagtcgttgcgatctgaggcgaacagcaaccgcaactcaccaccgtcggttgtcgccgatgcgattggaaaggccgtgacggcacgtcaccccaagacccgctatgccatcggcttcggtgccaaaccgctgattgcctcgcgcaacatcctcaccgatcgccagttcgacccagtgatcactcgagcgactggcgtcccccgcgactgaccactcttctgcgcccgtca

SEQ ID NO: 112 - protein, 185 aa, Corynebacterium glutamicum
MTIDEGRRQFEVNVFGAMALTRLVLPHMQKQKWGTIVNITSMGGKIYTPLGGWYHGTKFALEALSDALRLEVAPFGIDVVVIEPGGIATEWGGIAADNLDAVSKDSAYKRQADAVSKSLRSEANSNRNSPPSVVADAIGKAVTARHPKTRYAIGFGAKPLIASRNILTDRQFDPVITRATGVPRD

SEQ ID NO: 113 - DNA, 406 bp, Corynebacterium glutamicum
  CDS (101)..(406): FRXA02836
ccatcactcggcttcaccgtctacggtgctgcccgcaggacagagcgcccccaaaagctcgcttcagacgggatccaccccctcgagatggacgtcaccgatgacaatcgatgaaggccgtcgccagttcgaggtcaatgtattcggcgcgatggccctcacccgactcgtcctgccccacatgcagaaacaaaagtgggggacgatcgtgaacatcacatcgatgggcgggaagatctacacgcctctcggcggctggtatcacggcaccaagttcgccctcgaggccctctcggacgccctccgcctggaggtcgccccattcggcatcgacgttgttgtcatcgaaccgggcggcatcgccaccgagtggggaggaatcgctgccgacaatctcgacgcagtg

SEQ ID NO: 114 - protein, 102 aa, Corynebacterium glutamicum
MTIDEGRRQFEVNVFGAMALTRLVLPHMQKQKWGTIVNITSMGGKIYTPLGGWYHGTKFALEALSDALRLEVAPFGIDVVVIEPGGIATEWGGIAADNLDAV

SEQ ID NO: 115 - DNA, 1227 bp, Corynebacterium glutamicum
  CDS (101)..(1204): RXA02578
ggcaaaaatgaggaacagcacgcccgcaataatgaggaccgttgcagatcgcttcataaaaacagcccacacctttccgctaaactcgcatgttgaaataatgtctacccaatcatatgcacccatccgccatcgcggattcatcagctcactcgagggactacgcgcaatcgcctccctgggagtcttggcgacccacgttgcattccaaacctccgtcgaccccgccagcaacatcggtgcagtactcgcgcgtttcgactttttcgtcgccgtcttcttcgccctctccgccttcgttctttggcgacgccgcgccgggcaaccagtgggactgtactacctcaaacgcctagcccgcatcatgcccgcatactgggcaacggtcattgcagtcctgctgtttattcccaccggcccctggttagccaacctgacgatgacccaaatctactggccagacgggctcatgacaggcctcacccacctttggtccctgtgcgtggaagtggcgttttacctggtgatgccgcttctcgcgtgggtgttggataggtttggtcggccggtgcgcatcctgttgattgttggtggggcagtgttgagtctggcgtggccgtggattccccttgtggagcatgcgttggacgaggggtgggcgaacatgcagatctggccacccgcttacgcttgctggtttgcagtcggcatgatcgccgcagaaattgaaggagttcgattcccacgggttccgagctttgtgtgggtgggtttagctttagtggtcgcttggatcgcgggccaagaatggttcggaccactaggtttagtgcaccccagcccctgggaattcaacttaagagtcctcgcgggcacacttttcgctgtatttctggtggttccctacgcgctgggtacgccctctcggcttcttgattccagttggatgaaaacgctcggcacctggtcgtattccatcttcctctggcaccttcccgtgctgacgattgtgttcccactgctcgggttgcctttatttagtggaaatttcctgttggtgttcatcgtgacggtcttgttgacgatcccagttgccgccatcagctacaccttcatcgaagagcccatcagcggtggacccggcgcgccattcaggctgggggtcgttaggattcaccatttttctgggggtaggtctggaaaatgatgaattggcaccacgtcaag

SEQ ID NO: 116 - protein, 368 aa, Corynebacterium glutamicum
MSTQSYAPIRHRGFISSLEGLRAIASLGVLATHVAFQTSVDPASNIGAVLARFDFFVAVFFALSAFVLWRRRAGQPVGLYYLKRLARIMPAYWATVIAVLLFIPTGPWLANLTMTQIYWPDGLMTGLTHLWSLCVEVAFYLVMPLLAWVLDRFGRPVRILLIVGGAVLSLAWPWIPLVEHALDEGWANMQIWPPAYACWFAVGMIAAEIEGVRFPRVPSFVWVGLALVVAWIAGQEWFGPLGLVHPSPWEFNLRVLAGTLFAVFLVVPYALGTPSRLLDSSWMKTLGTWSYSIFLWHLPVLTIVFPLLGLPLFSGNFLLVFIVTVLLTIPVAAISYTFIEEPISGGPGAPFRLGVVRIHHFSGGRSGK

SEQ ID NO: 117 - DNA, 924 bp, Corynebacterium glutamicum
  CDS (101)..(901): RXA02150
gtgtttttcggtgggctgcgatgacgcatgtccaccaaaagagccaccccttaaagaaattaaaaagtggttttggtagcttcgcagcaaaatacacatcgtgggtaacgtattcttagaagttcctacagcagtaaagcgcgaagaaggggtaaacccaaacatcatgaaaaacaactggtatcggcttttcaagtatgtgctaattggcccgtttttgcgtgtgtacaaccgcccggagatcgaaggcaaagaaaacatccctgcagaaggtgccgcgatcatggcgtccaaccacgaagcagtgatggattccttttattttcccctgctgtgcccacggcagctgaccttcccagcgaaggccgaatacttcacatcaccaggtattaaaggcaagatgcagaagtggttttttacttctgtggggcaagtacccctggaccgcaccgcagataatgccatggattctttgatgaataccgccaaaatggtgctggatcggggagacctcttcggtatttaccctgaaggatctcgttcgcccgatggtcgcatctacaagggcaaaaccggaatggcctatgttgcgatggaaactggtacgacagttatccccgttgccatgattggcagccgggacgcgaaccctatcggaagttggtttccgaaacccgcaaaagtcaggatcaaggtaggaagcccaattgatcccctcgcattcgtcaaagaacatgggttgaagcctggaacctacgaagcagcgcgcaagctgacagatcacgttatgttcattcttgctgatctcactggtcagccgtatgttgatgcgtactctaaagatgtgaaaaacgctctggaggaaggaaaaggatacccggagggcacagctccttcacagtaatcgggtcttttctgttaaaa

SEQ ID NO: 118 - protein, 267 aa, Corynebacterium glutamicum
VGNVFLEVPTAVKREEGVNPNIMKNNWYRLFKYVLIGPFLRVYNRPEIEGKENIPAEGAAIMASNHEAVMDSFYFPLLCPRQLTFPAKAEYFTSPGIKGKMQKWFFTSVGQVPLDRTADNAMDSLMNTAKMVLDRGDLFGIYPEGSRSPDGRIYKGKTGMAYVAMETGTTVIPVAMIGSRDANPIGSWFPKPAKVRIKVGSPIDPLAFVKEHGLKPGTYEAARKLTDHVMFILADLTGQPYVDAYSKDVKNALEEGKGYPEGTAPSQ

SEQ ID NO: 119 - DNA, 504 bp, Corynebacterium glutamicum
  CDS (101)..(481): RXA00607
cactgccagcaacgccaacggttgaacccgaaccagaaggcgatgaagactggcccgaacccatcaaccccgcaggcgataacaaagaggaggcaaaccgatgattctcgcactgacagtcgcgatacttttcggtggaggtgtctacctcattcagcaacgcggaatggtgcgcatcgtcttcggcatgtcactgatcggccacgcagcgaacctgaccatcctgtacgccggtgtgcccacgtggcgcggcgaagccttccccgacaggaccccgcttaccgacgccgccgatccactcccccaggccttcgtcctcaccgccatcgtcatcgcgatggccaccacaaccatcatgttggccttggcagcactgggacgcagcgacgacacccggtccatcgaaccagatgacgatcaatcgcctttgactactagcgctcgttcagtcaccaacccaacagatcaggaggataaagcttaaatggccatggatgttctcct

SEQ ID NO: 120 - protein, 127 aa, Corynebacterium glutamicum
MILALTVAILFGGGVYLIQQRGMVRIVFGMSLIGHAANLTILYAGVPTWRGEAFPDRTPLTDAADPLPQAFVLTAIVIAMATTTIMLALAALGRSDDTRSIEPDDDQSPLTTSARSVTNPTDQEDKA

SEQ ID NO: 121 - DNA, 1119 bp, Corynebacterium glutamicum
  CDS (101)..(1096): RXA02397
gtgtgaataaaacttgtttcctggtcatttcccctactgaactgcgcttatgcctatgcttagaaaccagagacaagcttaagaaggacaggggccggccatgaatgatttcgaaacaaccatcgatcggatctctaaagaacaagatcccgcagcccgaagccgcgtggaacagttcattgtggaaacagtacgtgcactacccaacttgaccaccaaacaaggtgcatcgttggctatccaacttcttgatgcggtacagctcgcggatgcggcgggaaccaaggggggtgcgtcgacaagcaatgcttcatcgctgcctgacacctttgacgcgctgaccagcctgattggcaagctcgatgtgcgcagcgattctgaatggcgctcgtttgggttccagccttctgaaactgcgcacccgctaatgatcgctatccctgagattgagattttttatcagcacaccgatgtggagccgggaagcgatgacgccgtggcgccggactttcaggaaaatcaggatatgtggcgcaggcgtctcggatctgtcaccgaaccaaaccttatatataaagagttttccggacccggcaaagcgcagcgtgccgtagaaatgctgggcaatctgtggaagatcggcgtggtggtgagtaggaatacggaaagtcgccttgggttaactcgtgtggaatacacccccacccctggcgaagtacccgtgccgctgatgtcggagaagaactgttggtacagcattcgggtgtctgaaaccattggtgagaaccaggttccggaaattgtgcgctgcttaggcgagattttctgtggctatcttccccagatgtggctcaaagaaccagtaaaggccggcaagttgcgaatccaagaatcggaagcagcagcgtatatcgcgatggcgcgactagatctttccccacgcaccggcaacaccacttggaccaacagctatatttccacgcgtcctctctcccccgcttttaggtgggacgtggtgctggaggcttcccaccaattggagaacctgctgcgtggagacacagggccggtcactgccacacaatcggcagctggttaaccaaaagttcacgtggagat

SEQ ID NO: 122 - protein, 332 aa, Corynebacterium glutamicum
MNDFETTIDRISKEQDPAARSRVEQFIVETVRALPNLTTKQGASLAIQLLDAVQLADAAGTKGGASTSNASSLPDTFDALTSLIGKLDVRSDSEWRSFGFQPSETAHPLMIAIPEIEIFYQHTDVEPGSDDAVAPDFQENQDMWRRRLGSVTEPNLIYKEFSGPGKAQRAVEMLGNLWKIGVVVSRNTESRLGLTRVEYTPTPGEVPVPLMSEKNCWYSIRVSETIGENQVPEIVRCLGEIFCGYLPQMWLKEPVKAGKLRIQESEAAAYIAMARLDLSPRTGNTTWTNSYISTRPLSPAFRWDVVLEASHQLENLLRGDTGPVTATQSAAG

SEQ ID NO: 123 - DNA, 1462 bp, Corynebacterium glutamicum
  CDS (101)..(1462): RXN03110
aatgagtgaacctgcgcttgaactataccccctggggtattactgtagattctcaataccccgaggggtatctagtttttacgttgagaaggagagctcagtgcttattgaacgcatctacgacgaagaccttgcgcaggccagctatttcattggctgccaagcccacaacaccgcagtcgtggttgatccgcgtcgcgatattgccgtctatctggacatggccaagaaaaacggaatggagattgttggagttaccgaaacccatatccatgcggactatttgtcaggaacccgtgagttagctgctgcaactaatgccaccatgtacgtctcaggggagggcggcgccgattggcagtatgaattcgacgccgagcgaatatgcgacggcagcgagattcgcctgggaaatctggtgctcacagctgttcacaccccaggccataccccggaacacttatcgttcctgctgaaggacggcgcgttcgcagatgagccaggattcatgctcactggcgatttcgttttcgcgggtgatcttggccgaccagatttgctcgatgaagcagctgggggagtggacactcgttttgagggggctcgccaaatgttcaagagcttgaaggaaaaattcctgacattgcctgatcacatccagatcttccctggtcatggttccggttccgcgtgtggcaaagccttgggttcggttccttcaacaacacttggatatgaacgtcaatttgcgtggtggggaaagtatctggaggcagatgatgaacaaggattcattgatgagcttctggaaggccaacctgatgcacctgcatacttcggcaggatgaagaggcaaaataggcaagggcccgcaattatgggcgctcgcgagctgttgccacagctggaagcttctgatctgcacgacgtcattgttgttgatacccgctcagccgatgaagttcaccagggcactgtagctggtgcagtgaatattcctgcgggcaattcgatggcgaaatttggctcgtggaccgttgatcccgagaaggattcccgagctttggttctgctcgcggcaagccaaattggtgccatggagatgtgggaccacatggttcgcgtgggaatcgataatgttgctggttttatcaccaactttgatggggtggacctagttgcaccgcaaactgtgtccccagatcagctggatgaattggaatacgatctacttcttgatgtccgcaaccgcagtgaagtcgaagaaggctacatcccaggagcactccatattaatggtgcatccgtgctgtggaatctggagaaactgccacgtgacggaaagatcgtgagctactgcaagagtggaacacgcagctcaatcgccgcaagcaccctgcgtaatgctggttttgatgtggtggaacttcaaggatcctatgacaactgggtccggcacaac

SEQ ID NO: 124 - protein, 454 aa, Corynebacterium glutamicum
VLIERIYDEDLAQASYFIGCQAHNTAVVVDPRRDIAVYLDMAKKNGMEIVGVTETHIHADYLSGTRELAAATNATMYVSGEGGADWQYEFDAERICDGSEIRLGNLVLTAVHTPGHTPEHLSFLLKDGAFADEPGFMLTGDFVFAGDLGRPDLLDEAAGGVDTRFEGARQMFKSLKEKFLTLPDHIQIFPGHGSGSACGKALGSVPSTTLGYERQFAWWGKYLEADDEQGFIDELLEGQPDAPAYFGRMKRQNRQGPAIMGARELLPQLEASDLHDVIVVDTRSADEVHQGTVAGAVNIPAGNSMAKFGSWTVDPEKDSRALVLLAASQIGAMEMWDHMVRVGIDNVAGFITNFDGVDLVAPQTVSPDQLDELEYDLLLDVRNRSEVEEGYIPGALHINGASVLWNLEKLPRDGKIVSYCKSGTRSSIAASTLRNAGFDVVELQGSYDNWVRHN

SEQ ID NO: 125 - DNA, 1023 bp, Corynebacterium glutamicum
  CDS (1)..(1023): FRXA00660
ccaggccataccccggaacacttatcgttcctgctgaaggacggcgcgttcgcacatgagccaggattcatgctcactggcgatttcgttttcgcgggtgatcttggccgaccagatttgctcgatgaagcagctgggggagtggacactcgttttgagggggctcgccaaatgttcaagagcttgaaggaaaaattcctgacattgcctgatcacatccagatcttccctggtcatggttccggttccgcgtgtggcaaagccttgggttcggttccttcaacaacacttggatatgaacgtcaatttgcgtggtggggaaagtatctggaggcagatgatgaacaaggattcattgatgagcttctggaaggccaacctgatgcacctgcatacttcggcaggatgaagaggcaaaataggcaagggcccgcaattatgggcgctcgcgagctgttgccacagctggaagcttctgatctgcacgacgtcattgttgttgatacccgctcagccgatgaagttcaccagggcactgtagctggtgcagtgaatattcctgcgggcaattcgatggcgaaatttggctcgtggaccgttgatcccgagaaggattcccgagctttggttctgctcgcggcaagccaaattggtgccatggagatgtgggaccacatggttcgcgtgggaatcgataatgttgctggttttatcaccaactttgatggggtggacctagttgcaccgcaaactgtgtccccagatcagctggatgaattggaatacgatctacttcttgatgtccgcaaccgcagtgaagtcgaagaaggctacatcccaggagcactccatattaatggtgcatccgtgctgtggaatctggagaaactgccacgtgacggaaagatcgtgagctactgcaagagtggaacacgcagctcaatcgccgcaagcaccctgcgtaatgctggttttgatgtggtggaacttcaaggatcctatgacaactgggtccggcacaac

SEQ ID NO: 126 - protein, 341 aa, Corynebacterium glutamicum
PGHTPEHLSFLLKDGAFAHEPGFMLTGDFVFAGDLGRPDLLDEAAGGVDTRFEGARQMFKSLKEKFLTLPDHIQIFPGHGSGSACGKALGSVPSTTLGYERQFAWWGKYLEADDEQGFIDELLEGQPDAPAYFGRMKRQNRQGPAIMGARELLPQLEASDLHDVIVVDTRSADEVHQGTVAGAVNIPAGNSMAKFGSWTVDPEKDSRALVLLAASQIGAMEMWDHMVRVGIDNVAGFITNFDGVDLVAPQTVSPDQLDELEYDLLLDVRNRSEVEEGYIPGALHINGASVLWNLEKLPRDGKIVSYCKSGTRSSIAASTLRNAGFDVVELQGSYDNWVRHN

SEQ ID NO: 127 - DNA, 756 bp, Corynebacterium glutamicum
  CDS (101)..(733): RXA00801
ggataagtttgtttctgagcgtattggtcttgatgatgttgaagaggctttcaacaccatgaaggctggcgacgtgctgcgttctgtggtggagatctaaatggctcacgacggattgcgcgtagaaaacattgtcacctcaggcatctttgcccttgatggtggcgaatgggaagtcgacaacaacatctgggttgtgggaaatgatgatgaggttttcatcatcgatgcggcacacactgcagcacccatcatcgaggctgtcggtggacgtgctgtgaagggcattttgtgcacccacgcacacaatgaccacatcactgtcgcaccagagctatccaaggaatttgatgcaccaatcttcgtgcacccaggtgaccaaatgctgtgggaggaaacccacggaaacctgacccacgaggatttggcagatcagcagaagttccaaatcgctggaactgaactgatcgtgcttaatacccctggacactcacctggatccagctgcttctacctccctgaagcaaacgagctcttctctggagacactttgttccagggtgggccgggagcaactggccgtaagtacagctcctttgacaccatcattgagtccctcaagacctcaattttggatctaccagcggaaaccaccgtgcgcactggccatggtgatcacaccagtgtgggggctgaggctccacacttggaggaatggattaaacgcgggcactaagccccgaacgattagtaggc

SEQ ID NO: 128 - protein, 211 aa, Corynebacterium glutamicum
MAHDGLRVENIVTSGIFALDGGEWEVDNNIWVVGNDDEVFIIDAAHTAAPIIEAVGGRAVKGILCTHAHNDHITVAPELSKEFDAPIFVHPGDQMLWEETHGNLTHEDLADQQKFQIAGTELIVLNTPGHSPGSSCFYLPEANELFSGDTLFQGGPGATGRKYSSFDTIIESLKTSILDLPAETTVRTGHGDHTSVGAEAPHLEEWIKRGH

SEQ ID NO: 129 - DNA, 966 bp, Corynebacterium glutamicum
  CDS (101)..(943): RXA00821
ttaaaagcttgcttctcgacgcaaaaacccatccggcgcatcccttcaatgttaggggtgcgctgctatttttctccccagttctacgaaatgacttattgtgactaagcttgagcgcatggagcatcctgcttacagccaattgcggccggttaccccgtccgcatctgttgttttgtgccctaatcccggttacagctcgctggaaggcactaattcttgggttatccgggcaccagaagacccccggagcattgtcatcgatccaggtcctgaagatgagggccaccttaacgtcttgcattccaaggctgaggaggtgggtttgattcttctgacccaccgtcactatgatcatgctgacggcgcacagcgtttccgtcagctgaccaatgcacctgtgcgtgcgatggacccttcgtactgtgctggtgcggaggagattcatgatggtgagatcatcacgatcgacggtgtcaccccacagattgaggtggtggccacacctggtcatacccgtgattctgtgtcttatttcatctggagtggagtccctcatgagtccactttggagggcatcgtttctggcgacaccattgcgggtcgtcacaccacgatgatttcagagaccgacggcgatttgggtgagtacctgaattctttggccattttggaggagcgcggcaaggatattccgctgcttccaggacatggtccagatggacaggacgtgtcctccttcgcgcgtaagtacattgagcgtcgtgagctgcgtctgaaccagatccgtgaggtatgggagacccgtggccgtgacgtgtccatgaaggatctcatcgacgccatctacgatgatgttgatccagttctgcgtggtgcagccgagcagtccactcatgtggctattcgttacctgcaggctcaggaagcttccgcctcaaactaaacacttttaactaaacaaca

SEQ ID NO: 130 - protein, 281 aa, Corynebacterium glutamicum
VTKLERMEHPAYSQLRPVTPSASVVLCPNPGYSSLEGTNSWVIRAPEDPRSIVIDPGPEDEGHLNVLHSKAEEVGLILLTHRHYDHADGAQRFRQLTNAPVRAMDPSYCAGAEEIHDGEIITIDGVTPQIEVVATPGHTRDSVSYFIWSGVPHESTLEGIVSGDTIAGRHTTMISETDGDLGEYLNSLAILEERGKDIPLLPGHGPDGQDVSSFARKYIERRELRLNQIREVWETRGRDVSMKDLIDAIYDDVDPVLRGAAEQSTHVAIRYLQAQEASASN

SEQ ID NO: 131 - DNA, 1530 bp, Corynebacterium glutamicum
  CDS (101)..(1507): RXN02966
aaatataccccccagggtatcttgacagattaaagctcgatgttttaggctctacatatacccccacgggtatcccctcaactttgatctaaggtgtcacatgctttttgaacgcatctacgaagaaggcctcgcccaagccagctatttcattggctgccaacgcgaaggcaaagcgattgttgttgatgctcgccgagatatccagacctatctggaccttgcagcaaaaaacaacatggtcattagcgccgtaaccgaaacccatattcatgccgattatctctccggtactcgcgaacttgcagctgccaccggcgccgagattttcctctctggcgaaggcggagctgattggcaatatggctttacaggcaccaccttgatgcacaattccaccatcaagctgggaaatatcaccatcacagccaagcacactcccggacacactccagagcacctgtcatttttgattactgatggtgcggtctcaaaggatcccggttttatgctcagcggtgacttcgtcttcgtaggtgacgtgggacgtccagatttacttgatgaggcagctggcggcgtggacacccgcttcgccggagcacagcaactcttccatagcctaaaagagcagttccttgcactccccgaccacattcaggtttatccaggtcatggtgctggcagcccttgtggcaaggcattgggcgcgatccctagcaccaccgtgggatatgaaaaggctaatgcgtggtgggctccatatctgcgcagtgatgatgaagccggctttgtggaagagcttctcgacggccagccagatgcccacgcttactttgctcgcatgaaaaagcagaacaagcagggacctgcagtacttagtacattatccccgcttgtgaagctagaagccgaggaagtcgtcgaaaagcttggttctgaagcagtatttgtggatacccgcgagcaaaaccaagtccatctcggaaccgttgttggggcattgaatattccgcgcggcgccaaggcgtccaattttgcggcgtgggttattgatcctcaaaaggatgctcaggaccttattgttttggctccggacgccaataccgctgcggatttccgcgacgctttgctgcgggttggcatcgacactgtgcgttatttcaccaacagtatcgatggattgcctacctttgtgccagaactcatctcccccgctgagctagctgagaccaactatgacgcactgattgatatccgtgcaaagtccgaatttgccgctggcagcattcccggcgcgcagcagctttctggaggttcggccatgtggcgcctcaatgagctgcctgcgggtggcactttggtaaccttctgccaatcaggagcgcgaaataccgtggtagccaatgctttgcgacgcgccggattcaccgttatcgagctcgagggcagctacgccgcgtgggaaaaatcagctgccaatcctaaaaacttgcagactgccgtctagttttagatccggcgctgtat

SEQ ID NO: 132 - protein, 469 aa, Corynebacterium glutamicum
MLFERIYEEGLAQASYFIGCQREGKAIVVDARRDIQTYLDLAAKNNMVISAVTETHIHADYLSGTRELAAATGAEIFLSGEGGADWQYGFTGTTLMHNSTIKLGNITITAKHTPGHTPEHLSFLITDGAVSKDPGFMLSGDFVFVGDVGRPDLLDEAAGGVDTRFAGAQQLFHSLKEQFLALPDHIQVYPGHGAGSPCGKALGAIPSTTVGYEKANAWWAPYLRSDDEAGFVEELLDGQPDAHAYFARMKKQNKQGPAVLSTLSPLVKLEAEEVVEKLGSEAVFVDTREQNQVHLGTVVGALNIPRGAKASNFAAWVIDPQKDAQDLIVLAPDANTAADFRDALLRVGIDTVRYFTNSIDGLPTFVPELISPAELAETNYDALIDIRAKSEFAAGSIPGAQQLSGGSAMWRLNELPAGGTLVTFCQSGARNTVVANALRRAGFTVIELEGSYAAWEKSAANPKNLQTAV

SEQ ID NO: 133 - DNA, 1530 bp, Corynebacterium glutamicum
  CDS (101)..(1507): FRXA01833
aaatataccccccagggtatcttgacagattaaagctcgatgttttaggctctacatatacccccacgggtatcccctcaactttgatctaaggtgtcacatgctttttgaacgcatctacgaagaaggcctcgcccaagccagctatttcattggctgccaacgcgaaggcaaagcgattgttgttgatgctcgccgagatatccagacctatctggaccttgcagcaaaaaacaacatggtcattagcgccgtaaccgaaacccatattcatgccgattatctctccggtactcgcgaacttgcagctgccaccggcgccgagattttcctctctggcgaaggcggagctgattggcaatatggctttacaggcaccaccttgatgcacaattccaccatcaagctggaaaatatcaccatcacagccaagcacactcccggacacactccagagcacctgtcatttttgattactgatggtgcggtctcaaaggatcccggttttatgctcagcggtgacttcgtcttcgtaggtgacgtgggacgtccagatttacttgatgaggcagctggcggcgtggacacccgcttcgccggagcacagcaactcttccatagcctaaaagagcagttccttgcactccccgaccacattcaggtttatccaggtcatggtgctggcagcccttgtggcaaggcattgggcgcgatccctagcaccaccgtgggatatgaaaaggctaatgcgtggtgggctccatatctgcgcagtgatgatgaagccggctttgtggaagagcttctcgacggccagccagatgcccacgcttactttgctcgcatgaaaaagcagaacaagcagggacctgcagtacttagtacattatccccgcttgtgaagctagaagccgaggaagtcgtcgaaaagcttggttctgaagcagtatttgtggatacccgcgagcaaaaccaagtccatctcggaaccgttgttggggcattgaatattccgcgcggcgccaaggcgtccaattttgcggcgtgggttattgatcctcaaaaggatgctcaggaccttattgttttggctccggacgccaataccgctgcggatttccgcgacgctttgctgcgggttggcatcgacactgtgcgttatttcaccaacagtatcgatggattgcctacctttgtgccagaactcatctcccccgctgagctagctgagaccaactatgacgcactgattgatatccgtgcaaagtccgaatttgccgctggcagcattcccggcgcgcagcagctttctggaggttcggccatgtggcgcctcaatgagctgcctgcgggtggcactttggtaaccttctgccaatcaggagcgcgaaataccgtggtagccaatgctttgcgacgcgccggattcaccgttatcgagctcgagggcagctacgccgcgtgggaaaaatcagctgccaatcctaaaaacttgcagactgccgtctagttttagatccggcgctgtat

SEQ ID NO: 134 - protein, 469 aa, Corynebacterium glutamicum
MLFERIYEEGLAQASYFIGCQREGKAIVVDARRDIQTYLDLAAKNNMVISAVTETHIHADYLSGTRELAAATGAEIFLSGEGGADWQYGFTGTTLMHNSTIKLENITITAKHTPGHTPEHLSFLITDGAVSKDPGFMLSGDFVFVGDVGRPDLLDEAAGGVDTRFAGAQQLFHSLKEQFLALPDHIQVYPGHGAGSPCGKALGAIPSTTVGYEKANAWWAPYLRSDDEAGFVEELLDGQPDAHAYFARMKKQNKQGPAVLSTLSPLVKLEAEEVVEKLGSEAVFVDTREQNQVHLGTVVGALNIPRGAKASNFAAWVIDPQKDAQDLIVLAPDANTAADFRDALLRVGIDTVRYFTNSIDGLPTFVPELISPAELAETNYDALIDIRAKSEFAAGSIPGAQQLSGGSAMWRLNELPAGGTLVTFCQSGARNTVVANALRRAGFTVIELEGSYAAWEKSAANPKNLQTAV

SEQ ID NO: 135 - DNA, 675 bp, Corynebacterium glutamicum
  CDS (101)..(652): RXA01853
gaatgtccaacgtcaaaaaaattcttttctatcctaaccgtatcttcacaccttgagggaatgatgggggagcgccgcttacgcactacactgtttattcatggagatcctcggattcgcggctggtccgtataaaacaaattgctatgtggtgcgcggggagaatgaggtcgcgatcattgatcctggcatgcatgcccacgatgatttggtggaatacatcaccacgaataatttgagcgtggacaagattgtgctcacccacggacacattgatcacacccgtgatgctggtgttgtggcaaagcgtttcaatgcgccggtctatatccatcctgatgatgcgtttttccttgaggtctacaagggatctggaacaaagacggccatgcttttcgacgccgacaacatggtgtcccctgatcctgagtcactgcgtgatctggttgatggtgagacaatcactttggctggcgaagaattcacgttgaagcatgcaccagggcattcacctggttgtacgctgatcgtcggcaaggaatactgctttagcggtgatgtgttgttcaagggctctattggtcgcactgattttgagtggtctgatgcagatgccatgaatgagtcactacgcacggcagtgctcccactttgatgatgcattgcagattcttc

SEQ ID NO: 136 - protein, 184 aa, Corynebacterium glutamicum
MEILGFAAGPYKTNCYVVRGENEVAIIDPGMHAHDDLVEYITTNNLSVDKIVLTHGHIDHTRDAGVVAKRFNAPVYIHPDDAFFLEVYKGSGTKTAMLFDADNMVSPDPESLRDLVDGETITLAGEEFTLKHAPGHSPGCTLIVGKEYCFSGDVLFKGSIGRTDFEWSDADAMNESLRTAVLPL

SEQ ID NO: 137 - DNA, 723 bp, Corynebacterium glutamicum
  CDS (101)..(700): RXN02424
agccaatgctcaactgcccttcaaaatcgatttttgtcgcttcaaaaaatacaccttcgaacatagcatcgaacaaggtgtttccgctagtctgaaccacatgactaacgagctcactcttcaccatatttccgtgtcccaaatggacaacaattgctaccttttggccgcaaatggcaacggtttactcattgatgctgcagatgacgcagctgcactacttaaattagccgaagatgccggtgtgaccatcaccaaagtgttgaccacccaccgccacgcagaccacgtccgtgcattgccggaggttctccagaagaccggagcaactcactacgcgcctttccttgaggtgccagctttgccctccgctgttgatgtggaactgcatcatggtgattcaattgaatttgagggtcatgtattccctatcagcattctgcgcggccacaccccaggcggtgcagtactcaccgctgagatcgacggtaaaactcaccttttcgtgggtgacagcctcttccccggcggtttgggcaaaaccagcagcgaaggcgacttcgtccgactgttcaacgatgtcaaagagcgcatctttgacacctacgacgatgacagcatcgtgtggccaggtcacggcaaggaaaccacccttggagccgagcgtccacagctggaaatctggtgggagcgtcgctggtaagcgcttttctcaaccaggca

SEQ ID NO: 138 - protein, 200 aa, Corynebacterium glutamicum
MTNELTLHHISVSQMDNNCYLLAANGNGLLIDAADDAAALLKLAEDAGVTITKVLTTHRHADHVRALPEVLQKTGATHYAPFLEVPALPSAVDVELHHGDSIEFEGHVFPISILRGHTPGGAVLTAEIDGKTHLFVGDSLFPGGLGKTSSEGDFVRLFNDVKERIFDTYDDDSIVWPGHGKETTLGAERPQLEIWWERRW

SEQ ID NO: 139 - DNA, 404 bp, Corynebacterium glutamicum
  CDS (1)..(381): FRXA02424
accggagcaactcactacgcgcctttccttgaggtgccagctttgccctccgctgttgatgtggaactgcatcatggtgattcaattgaatttgagggtcatgtattccctatcagcattctgcgcggccacaccccaggcggtgcagtactcaccgctgagatcgacggtaaaactcaccttttcgtgggtgacagcctcttccccggcggtttgggcaaaaccagcagcgaaggcgacttcgtccgactgttcaacgatgtcaaagagcgcatctttgacacctacgacgatgacagcatcgtgtggccaggtcacggcaaggaaaccacccttggagccgagcgtccacagctggaaatctggtgggagcgtcgctggtaagcgcttttctcaaccaggca

SEQ ID NO: 140 - protein, 127 aa, Corynebacterium glutamicum
TGATHYAPFLEVPALPSAVDVELHHGDSIEFEGHVFPISILRGHTPGGAVLTAEIDGKTHLFVGDSLFPGGLGKTSSEGDFVRLFNDVKERIFDTYDDDSIVWPGHGKETTLGAERPQLEIWWERRW

SEQ ID NO: 141 - DNA, 882 bp, Corynebacterium glutamicum
  CDS (101)..(859): RXN00419
gctggttgaagactcgaaatgagatcgacccaaccggagtctttgcatctgacatgtcccgccgacttgagctttcttaagaaagggcttgaactaaacaatgcttaacgcagtgggcaaagcccaaaacattctccttcttggtggaacctctgagatcggtatttccattgtctcccgcttcctcaagcagggtccatcccatgtgaccttggcagcgcgtaaagattccccacgcgtggacgcagcagtcgcagagatcaaagcagctggcgctgcttccgttgctgttgttgatttcgatgcgctcgacaccgaatcccaccctgcagccatcgacgcagcctttgaaaacggcgacgttgacgtagcaatcgtggctttcggcatcctcggcgacaacgaagcacagtggcgcgaccaagcactagcagtggaagcaaccaccgtgaactacaccgccggcgtttccgtaggtgtactgctgggccagaaatttgagcagcagggccacggcaccatcgtggcattgtcctctgtggcaggccagcgagtccgccgctccaactttgtctacggctccgccaaggcaggtttcgacggtttctacacccagctcggcgaagccctgcgtggatccggtgccaacgtattggtggttcgcccaggccaggtacgcaccaagatgtccgcagatggtggcgaagccccactgaccgtcaaccgcgaagacgtggcagatgctgtttatgatgcagtggtgaacaagaaggacatcatctttgtccacccactgttccagtacgtctcttttgcgttccaattcattccgcgagcaatcttccgcaagctgccgttctaacggaagttacggaagttacg

SEQ ID NO: 142 - protein, 253 aa, Corynebacterium glutamicum
MLNAVGKAQNILLLGGTSEIGISIVSRFLKQGPSHVTLAARKDSPRVDAAVAEIKAAGAASVAVVDFDALDTESHPAAIDAAFENGDVDVAIVAFGILGDNEAQWRDQALAVEATTVNYTAGVSVGVLLGQKFEQQGHGTIVALSSVAGQRVRRSNFVYGSAKAGFDGFYTQLGEALRGSGANVLVVRPGQVRTKMSADGGEAPLTVNREDVADAVYDAVVNKKDIIFVHPLFQYVSFAFQFIPRAIFRKLPF

SEQ ID NO: 143 - DNA, 485 bp, Corynebacterium glutamicum
  CDS (1)..(462): FRXA00419
gacaacgaagcacagtggcgcgaccaagcactagcagtggaagcaaccaccgtgaactacaccgccggcgtttccgtaggtgtactgctgggccagaaatttgagcagcagggccacggcaccatcgtggcattgtcctctgtggcaggccagcgagtccgccgctccaactttgtctacggctccgccaaggcaggtttcgacggtttctacacccagctcggcgaagccctgcgtggatccggtgccaacgtattggtggttcgcccaggccaggtacgcaccaagatgtccgcagatggtggcgaagccccactgaccgtcaaccgcgaagacgtggcagatgctgtttatgatgcagtggtgaacaagaaggacatcatctttgtccacccactgttccagtacgtctcttttgcgttccaattcattccgcgagcaatcttccgcaagctgccgttctaacggaagttacggaagttacg

SEQ ID NO: 144 - protein, 154 aa, Corynebacterium glutamicum
DNEAQWRDQALAVEATTVNYTAGVSVGVLLGQKFEQQGHGTIVALSSVAGQRVRRSNFVYGSAKAGFDGFYTQLGEALRGSGANVLVVRPGQVRTKMSADGGEAPLTVNREDVADAVYDAVVNKKDIIFVHPLFQYVSFAFQFIPRAIFRKLPF

SEQ ID NO: 145 - DNA, 259 bp, Corynebacterium glutamicum
  CDS (101)..(259): FRXA00421
gctggttgaagactcgaaatgagatcgacccaaccggagtctttgcatctgacatgtcccgccgacttgagctttcttaagaaagggcttgaactaaacaatgcttaacgcagtgggcaaagcccaaaacattctccttcttggtggaacctctgagatcggtatttccattgtctcccgcttcctcaagcagggtccatcccatgtgaccttggcagcgcgtaaagattccccacgcgtggacgcagcagtcgcagag

SEQ ID NO: 146 - protein, 53 aa, Corynebacterium glutamicum
MLNAVGKAQNILLLGGTSEIGISIVSRFLKQGPSHVTLAARKDSPRVDAAVAE

SEQ ID NO: 147 - DNA, 861 bp, Corynebacterium glutamicum
  CDS (101)..(838): RXN02923
gcatctacattgaaggaatccacggagcgcgcatcgaagacatcgttgtggtgaatgaagacggttgtgaaaccctcaacaaccagcccaaggaactgcgttgagcattcttctcctaggcggaacctctgacattgccggtgagattgccacgttgacgtgtcacggcgaagacgttgttttggctgctcgtcgaccagaggctgcacagggcttagcggaagatcttcgacagcgcggtgccacatctgttcatgttttgagctttgacgcccaagtactagacacgcaccgagaacttgtgaagaaaacacaagagctagctggcgagatttcccttgccgtggttgcttttggcatcttgggagaccaagaacgcgcagaaaccgatgagacccatgcggtagagatcgccaccgtggattacaccgctcaggtctccatgctcactgtgcttgctgatgagctccgcgcacaaactactccagcagcgatcgtggcgttttcctcgattgctgggtggcgggcgcgccggcctaactatgtctatggatccaccaaggctggtctcgatgcattttgccaagggcttgcagatagcctgcatgggacacacgtgcgattgattattgcgcgtcctggctttgttattggttctatgaccacggggatgaagcctgctccgatgtcggtgtatccacgagatgttgccgcagctgttgttagtgcttatacctctaagaagaggagcacgaccttgtggattccgggacgtctgcgggttctcgcctggattatgcggatggttcctcgtccggtgtggcggaagatgccacgctagatacccgttcagccctcaca

SEQ ID NO: 148 - protein, 246 aa, Corynebacterium glutamicum
LSILLLGGTSDIAGEIATLTCHGEDVVLAARRPEAAQGLAEDLRQRGATSVHVLSFDAQVLDTHRELVKKTQELAGEISLAVVAFGILGDQERAETDETHAVEIATVDYTAQVSMLTVLADELRAQTTPAAIVAFSSIAGWRARRPNYVYGSTKAGLDAFCQGLADSLHGTHVRLIIARPGFVIGSMTTGMKPAPMSVYPRDVAAAVVSAYTSKKRSTTLWIPGRLRVLAWIMRMVPRPVWRKMPR

SEQ ID NO: 149 - DNA, 1203 bp, Corynebacterium glutamicum
  CDS (101)..(1180): RXN02922
cccaccgcggcgcaagctaccgcctaggcgctcggaactccaccgccactattgatctcagttccatatccgcccaactagtttcccagggagcccactcatgatctcaccgcaaacaatcatcgacaatcttgctccagtcctcgcggagatcgcagcaacggctgcgcagcgcgaacaggatcgagaattcagccgtgatttggcaaagcagcttagtgccggtgggttcactaaactccgcattccagttgaatttggcggtttgggttttagccttccagaagcatttgaggtgctggtggcagcggccgctgcagattcaaatatcgcgcagggattgcggcctcacttcttggcagtggagagcttattgatcgctccttattcagagcaccgcaccaagtggctgcgaaaaatcgctgagaaaggcgtggtcattggcaatgcgttgactgaagtgggaaacaagccaggtgagctgaaaaccaagatccgaaaggaaggcgagtcttacgttctcagcgacaccaagttctattccacgggcagtctttacgccgactggattcaagtacatgcgaaagatgaggaagatcaagatgttttcgcctttgttgatcgcgacgcatcaggcgttgttttggtggattactgggacgaatttgggcaacaactatttgcctccggaaccagcttctttgaaaaagtcgtggtagatccactggacattgtcacccgtgattacaccgcacccagcgctttccaggcgctggcgcagtcacatcatttgtctacgttgactggtatttcgcaggcaatcacccgtgacattgttacctatgtacaaaaccgcacccgtattttcagccacggaagtggtgaccttccacgctttgatccgcaggtgcaacaggtggtgggtgaggtgaaagccaagtcgtatgcagtcgagaaaatctttcagggtttcgcacaagaactggatcttgtcgtcgataaggcaaaagccggcactgctacggaggtcgatctggccgctgtcgacctgagcgcctaccaagcccagttagcggtggcacctttggtgctgagccaggccacccaggcctttgaggttggcgcagatgccttaaacggcggccacgtggctgcccaatacacgatcggatccttgtcatgagccaagaaattttgagccat

SEQ ID NO: 150 - protein, 360 aa, Corynebacterium glutamicum
MISPQTIIDNLAPVLAEIAATAAQREQDREFSRDLAKQLSAGGFTKLRIPVEFGGLGFSLPEAFEVLVAAAAADSNIAQGLRPHFLAVESLLIAPYSEHRTKWLRKIAEKGVVIGNALTEVGNKPGELKTKIRKEGESYVLSDTKFYSTGSLYADWIQVHAKDEEDQDVFAFVDRDASGVVLVDYWDEFGQQLFASGTSFFEKVVVDPLDIVTRDYTAPSAFQALAQSHHLSTLTGISQAITRDIVTYVQNRTRIFSHGSGDLPRFDPQVQQVVGEVKAKSYAVEKIFQGFAQELDLVVDKAKAGTATEVDLAAVDLSAYQAQLAVAPLVLSQATQAFEVGADALNGGHVAAQYTIGSLS

SEQ ID NO: 151 - DNA, 516 bp, Corynebacterium glutamicum
  CDS (101)..(493): RXN03065
gacggcgccaactctgcattcttcgcctcagcgtgcgtggcagtgtttgcactgatcgtgggcttctttgtaaagaggccagcccgctaagctaggtcgcatgatcagcattggaaccgacctcgttcacatttcggcgttcgcagagcagcttgcacagccgggaagttccttcatggaggtgttttccgcaggggagcgtcgtaaagcaaatgaacgccaggcaagccgctacgccgagcatttggcggggcggtgggcggcaaaagaatcctttattaaggcctggtcacaggccatttatggccagccacccgtgatcgccgaagaagccgtggtgtggcgggacatcgaagttcgcgcagacgcgtgggggcgcgtcgcgatcgaattggcgcccgaattggccgcagtggtccgggaatccatcggggagttttccagcagcttgagcatcagccacgacggcgactacgcggtggaacgtgcgtgttgactatccagtagccacggaga

SEQ ID NO: 152 - protein, 131 aa, Corynebacterium glutamicum
MISIGTDLVHISAFAEQLAQPGSSFMEVFSAGERRKANERQASRYAEHLAGRWAAKESFIKAWSQAIYGQPPVIAEEAVVWRDIEVRADAWGRVAIELAPELAAVVRESIGEFSSSLSISHDGDYAVERAC

SEQ ID NO: 153 - DNA, 543 bp, Corynebacterium glutamicum
  CDS (101)..(520): RXN03132
taacttatttatacataaaaacacaataaaaaccgcacacgcggcgaaacttcaataaatccctagactgcaaaaaatggttaggctaaccttatttccaatgaatgtgaatcaacagttgggagcccgcaccgccatgaaccaccctgagaccgcaaccgtccttcgctccatctctgacatggttagcaccgaaaccaatccgcgccgtaaaagccgcctcgagcagctcatttacgccaccgccagcgcctggccccactaccccattgcccacgcagcccaggccgcggtgcaattagccaggccaatgcgggtttttgagctccagagctttgaaggcgtcaagcacgcactccaccacatcgatcttcgccccgccctcgaatgggacatcatgggatttcccgaatcccccgacacgctgcccattttgctcagtgacctgcgcgaccccccttacgccaccactgctgtgccacctcaatccacgccacgctccgctcaccgatccacacattgacgcttccaggcgccaccgcg

SEQ ID NO: 154 - protein, 140 aa, Corynebacterium glutamicum
MNVNQQLGARTAMNHPETATVLRSISDMVSTETNPRRKSRLEQLIYATASAWPHYPIAHAAQAAVQLARPMRVFELQSFEGVKHALHHIDLRPALEWDIMGFPESPDTLPILLSDLRDPPYATTAVPPQSTPRSAHRSTH

SEQ ID NO: 155 - DNA, 461 bp, Corynebacterium glutamicum
  CDS (1)..(438): RXN03157
ggccacctcgacatcgtgacccgcgccgccgcgcaatttagcgaagtcaccatcttggtcaccgccaaccccaacaaaaactcaggactgttcaccgtcgcagaacgcatggatctcatccgcgaatccaccgcacacctggacaacgtaaaagtagacacttgggcctcactgctcgtggattacaccaccgaacatggcatcggcgccctagtcaaaggcctgcgaagctccctcgactacgaatacgagctccccatggcacagatgaacaggcgactcacgggcgtagacaccttcttcctcctcaccgacgagaaatacggctacgtcagctccacactgtgcaaagaagttgcccgcttcggtggcgatgtctccggcctcctacctgaggtagtggcaaaagccgtgacagaaaaatacagcaaccagcactagtttcttttgcatcaagcgtc

SEQ ID NO: 156 - protein, 146 aa, Corynebacterium glutamicum
GHLDIVTRAAAQFSEVTILVTANPNKNSGLFTVAERMDLIRESTAHLDNVKVDTWASLLVDYTTEHGIGALVKGLRSSLDYEYELPMAQMNRRLTGVDTFFLLTDEKYGYVSSTLCKEVARFGGDVSGLLPEVVAKAVTEKYSNQH

SEQ ID NO: 157 - DNA, 1206 bp, Corynebacterium glutamicum
  CDS (101)..(1183): RXN00934
ccaacccctgtggtttggtgatttggatccggagcgtctcaagcgctctagggagcagacaaatgttcacaaaccggtggcattacaggaggacaattaggtgcgaattggaatggtctgcccgtactccttcgatgagccgggcggtgttcaagcgcatatccttgacttagcgcgaaccttcattgcccaaggccatgaggttcaggtgcttggtccgtgtagtgcggatacgcaggtgcccgatttcgtggtgcgcggtggtggcagcatcccgattccgtacaatggctcggttgcccgcttgagctttgggccgaaaatgttcaaggccgtgcgcacgttcctccgcgaaggcaacttcgatgtgctgcatatccatgaaccgaattcaccaagtttttccatggcggcgctacgctttgcggaaggccccatcgttgctacttaccacgcctccagtagcggatcgaagctgctcaaggctttcttaccagtgctttcgcccatgctggagaaagtgcgcgcaggcatcgccgtgtctgaaatggctcggcgctggcaggtggagcaagtcggcggcgatcccgtgctgatccccaacggggtagagacctccatgttcaaagccgcgcgccaaatcgaaccgaatgatcctgtagagatcgtctttttgggtcgcctcgatgagtcccgcaaaggcctcgacatcctcctgcgcgctctgaccaggctggatcgcccgtttacctgcaccgtcattggcggcggcaccccgcgagaagtcgccggcatcaactttgtgggccgcgtcagcgatgaggaaaaggcagcaatcttaggtcgcgcagacatctatgtcgcacccaacaccggcggcgaaagcttcggcatcgtgctagttgaagcgatggccgcgggatgcgctgtcgtcgccagcgacctagaagcgttctccctggtcaccgattctgaagccgcacagccagcgggcgtgctatttaaaaccggctcagacgccgacctagccaaaaaacttcaagcgcttatcgacgacccctcctcccgttccacgcttatcgccgcggggctaaagcgcgcaaacgcctacgactggtcgacagtatccacccaggtcatggcagtctatgaaaccattgcgatcgacaaagtgaggcttggatgacccttgtttacctcctcatc

SEQ ID NO: 158 - protein, 361 aa, Corynebacterium glutamicum
VRIGMVCPYSFDEPGGVQAHILDLARTFIAQGHEVQVLGPCSADTQVPDFVVRGGGSIPIPYNGSVARLSFGPKMFKAVRTFLREGNFDVLHIHEPNSPSFSMAALRFAEGPIVATYHASSSGSKLLKAFLPVLSPMLEKVRAGIAVSEMARRWQVEQVGGDPVLIPNGVETSMFKAARQIEPNDPVEIVFLGRLDESRKGLDILLRALTRLDRPFTCTVIGGGTPREVAGINFVGRVSDEEKAAILGRADIYVAPNTGGESFGIVLVEAMAAGCAVVASDLEAFSLVTDSEAAQPAGVLFKTGSDADLAKKLQALIDDPSSRSTLIAAGLKRANAYDWSTVSTQVMAVYETIAIDKVRLG

SEQ ID NO: 159 - DNA, 1320 bp, Corynebacterium glutamicum
  CDS (101)..(1297): RXN00792
cacctttggtgctgagccaggccacccaggcctttgaggttggcgcagatgccttaaacggcggccacgtggctgcccaatacacgatcggatccttgtcatgagccaagaaattttgagccattttgcacccgcattagagcgcattcgaagcggcgccgtcgagcgcgaacagcagcgcgccttgccagtggaagagattaaagagctggtagagctaggttttactgggcttcgagtgcccgaagaactaggcggtgcgggcgcttccctggaaagcgtagttgagttactgatcgagatcgcgggcgccgattccaatatcgcccaagccctgcgcggacattttgccttcgtggaactactcctggaagcgccggagagcgaattccgcacccattggctgcgcgaagtcgccaccggaagacttgtgggcaacgccgaaagtgagaaacgcggcgtttacggcgatccgcagaccttcatcgatgaggtggagactgaaaacggaccgattttcgtgctcaacggcactaagttttataccaccggcacctattttgcggactacacctggaccaccgcgctgctgcgcaaccttaacggccaagaaactttggtcagtttgccggtcgatctgcacgcgccgggcgtggatgttgctgatgattggagcgggtttgggcaaaagctcaccgcctctggaacgaccacgtttaaagacctggaggtggatccgcggtggatcattccacgcactgatgcgcccacgctggtgtggacgtatctgcagctgagcctgctgaccgtgctggttggcagtgccgcagcagctgtcgatgaggtggttgcccgcgcccaatcctccaccagaaatgcgtggaaccctggcgtcgagcgccgcagcgatccggccgcaaccatagcgatcggcgacgcacgcagccgagtcaccgttattcgtggagcgcttctcgacgccacccgccacgtttccaacgccgccacgatcgtaacccccgaagccttcaacgaggcggacgctattgttgcagcgctctggcccatcgtctccggacaagctttggtggtgacatccaacgttttcgatgcggtgggtgcatctgcagtgcttggtgagcattccattgatcgccactggcgcaatgtgcgtaccgtgtcctcaaacaacccggtgttcctggccaagaatgcagtgggggagtatgccctcaacggcactcctgtgggtaccaacattggtaaagcactgagccgtccggtgagcctaagcagctagacgtgtgatttcgctggttt

SEQ ID NO: 160 - protein, 399 aa, Corynebacterium glutamicum
MSQEILSHFAPALERIRSGAVEREQQRALPVEEIKELVELGFTGLRVPEELGGAGASLESVVELLIEIAGADSNIAQALRGHFAFVELLLEAPESEFRTHWLREVATGRLVGNAESEKRGVYGDPQTFIDEVETENGPIFVLNGTKFYTTGTYFADYTWTTALLRNLNGQETLVSLPVDLHAPGVDVADDWSGFGQKLTASGTTTFKDLEVDPRWIIPRTDAPTLVWTYLQLSLLTVLVGSAAAAVDEVVARAQSSTRNAWNPGVERRSDPAATIAIGDARSRVTVIRGALLDATRHVSNAATIVTPEAFNEADAIVAALWPIVSGQALVVTSNVFDAVGASAVLGEHSIDRHWRNVRTVSSNNPVFLAKNAVGEYALNGTPVGTNIGKALSRPVSLSS

SEQ ID NO: 161 - DNA, 969 bp, Corynebacterium glutamicum
  CDS (101)..(946): RXN00931
ccgtaacctaatcgttgaaacatcaccttattgctgggctttgcacgctactctttgtgagtaacctcaccgaagtgcataaattaattgggagtgatcagtgaaaactattgaagatattttgaccttggaagaaatcgaccgcgatatttaccgtggtcccgttatcgaatcttatttagccaggactttcggtggccaggtcgctgcccaagctttagtagcagcaacgcatactgttgataaagcctttactgtgcattctttgcatggctactttatagctcctggtgatccaacagcacccgcaatttatttagtggatcgagttcgcgacggaaaaagctacgtcacccgctcggtgcgtggcatccaagacggcgaagtaatcttcagcatgcaggccagctttcatcgtggggatgaaggcattgagcacatggacaagatgcgtaaagttccagctcctgatgagatcaagggaacagtagaacgtatgccgatctcaagtaggcgagtgcttgatgaatgggcggaatgggatatccgcgttattccgcaggatcaattagaactcagcgatttcaccgctactgagcaagctgtgtggattcggtgcaccgctgatcttccggataatcccaccttccaccagtgctcactgacttatctgtccgatatgactttgctgcatagtgccctggtgccacacccaggtgagaaaatgcagatggcctcacttgatcacgctgtgtggttcctgcgtcccttccgcgtcgatgaatggttgctttatgatcagcgctctccatcggcctcaagtgggcgagccttgactcacgggcggcttttcaaccagcagggagatttggtcgctattgtcaatcaagagggaatgacccgcacactccacgagggtgcgcaatcaattccgatgcgcaaagactaaaatgcagcgaacttgaagat

SEQ ID NO: 162 - protein, 282 aa, Corynebacterium glutamicum
VKTIEDILTLEEIDRDIYRGPVIESYLARTFGGQVAAQALVAATHTVDKAFTVHSLHGYFIAPGDPTAPAIYLVDRVRDGKSYVTRSVRGIQDGEVIFSMQASFHRGDEGIEHMDKMRKVPAPDEIKGTVERMPISSRRVLDEWAEWDIRVIPQDQLELSDFTATEQAVWIRCTADLPDNPTFHQCSLTYLSDMTLLHSALVPHPGEKMQMASLDHAVWFLRPFRVDEWLLYDQRSPSASSGRALTHGRLFNQQGDLVAIVNQEGMTRTLHEGAQSIPMRKD

SEQ ID NO: 163 - DNA, 969 bp, Corynebacterium glutamicum; identical to SEQ ID NO: 161
  CDS (101)..(946): FRXA00931

SEQ ID NO: 164 - protein, 282 aa, Corynebacterium glutamicum; identical to SEQ ID NO: 162

SEQ ID NO: 165 - DNA, 510 bp, Corynebacterium glutamicum
  CDS (101)..(487): RXN01421
ttgatgcacgtgcagaaatcgtcggcggtccgtggcacccatctgttaagggagactcggttactgcagggatcctgcgagatcgagtaaacgcctaaagatgacgtcgaaaagcattagcggcaagcgcccgaatctgccgtcgctcactggagcgcggtggctcgcggcgctcgctgtttattttttgcatgcgttggtgtttttgtcggtgtatccgttccagcagtcggaactgtttgccacaatccataaatttgtccccatgcagctgggttcagctggtgtaaccttcttctttatcttgtccggatttttgatctattggtcaaatagccagctcaagggcatgaagaatgtgctgtattactgcaagcgccgcatcaccaagatttatcccatgcacttgattgcgttgccgatgtttattgaggcgtcggcgaagttcacgactacaggcattacctgggtgctgattttgcgcgagtaaagctgtggctgcggaatgcg

SEQ ID NO: 166 - protein, 129 aa, Corynebacterium glutamicum
MTSKSISGKRPNLPSLTGARWLAALAVYFLHALVFLSVYPFQQSELFATIHKFVPMQLGSAGVTFFFILSGFLIYWSNSQLKGMKNVLYYCKRRITKIYPMHLIALPMFIEASAKFTTTGITWVLILRE

SEQ ID NO: 167 - DNA, 930 bp, Corynebacterium glutamicum
  CDS (101)..(907): RXN02342
caggttcgtgctgcgtgcgggtagtttttaaaggtaaaactttttgggcgtgtcgcccttaaagcgcgcttttcgacgcgaccccactacattggcttccatgaacgttgacatttcacgatccagagagccgctaaacgttgagctcctgaaggaaaaattgctccaaaacggtgactttggccaggtcatttacgaaaaagtgacaggctccactaatgctgacttgctggcacttgcaggttctggcgctccaaactggacggtgaaaactgtcgagtttcaagatcatgcgcgtgggcgactcggccgcccgtggtctgcccctgagggttcccaaacaatcgtgtctgtgctcgttcaactatctattgatcaagtggaccggattggcactattccactcgcggcgggactcgctgtcatggatgcgttgaatgacctcggtgtggaaggtgccggactgaaatggcccaacgatgttcaaatccacggcaagaaactctgcggcatcctggtggaagccaccggctttgattccaccccaacagttgtcatcggttggggcactaatatcagcctgactaaagaggagcttcctgttcctcatgcaacttccctcgcattggaaggtgttgaagtcgacagaaccacattccttattaatatgctcacacatctgcatactcgactggaccagtggcagggtccaagtgtggattggctcgatgattaccgtgcggtatgttccagtattggccaagatgttcgagtgcttctacctggggataaagaactcttaggtgaagcgatcggtgtcgcgactggcggagaaattcgtgttcgcgatgcttcgggcaccgttcacaccctcaacgccggtgaaattacgcaccttcgcctgcagtaaggtgacggtatggggaattc

SEQ ID NO: 168 - protein, 269 aa, Corynebacterium glutamicum
MNVDISRSREPLNVELLKEKLLQNGDFGQVIYEKVTGSTNADLLALAGSGAPNWTVKTVEFQDHARGRLGRPWSAPEGSQTIVSVLVQLSIDQVDRIGTIPLAAGLAVMDALNDLGVEGAGLKWPNDVQIHGKKLCGILVEATGFDSTPTVVIGWGTNISLTKEELPVPHATSLALEGVEVDRTTFLINMLTHLHTRLDQWQGPSVDWLDDYRAVCSSIGQDVRVLLPGDKELLGEAIGVATGGEIRVRDASGTVHTLNAGEITHLRLQ

SEQ ID NO: 169 - DNA, 2762 bp, Corynebacterium glutamicum
  CDS (1)..(2739): RXN00563
ttctacaaggatctctacgcacgttccgcacgcggcacggcagcactgtggatcgtggcggctaacttgagctcctactcagacatcgacgccatcatcaactgggtcggatccgagcagaccaccaccgtcaacggcgcatccaagctggtcaagccagctttggtccctaccttgctgttcccattcgcggcacctcgcgtgtccggatccatggcagatgcaggcccacaggcagaatcccagatgcgacttctgctctggtctgttgagcgcctcatcgcaggtcttgcgccattgggctcctccatcaacgtgggtcaccgcctgcacgtggtcatcccaggttcaccaaaccgtggacgcttcggtggcgatggtgcatacggtgaatccaaggcagctctcgacgccgtggttacccgttggaacgcagagcaagctgcatggggagcacacacctccctcgtgcacgctcacatcggttgggttcgcggcaccggcctcatgggcggcaacgatcctttggtcaaggcagctgaagaagcaggcgtggaaacctactccacccaagaaattgcagagaaactgctgtcccaggcaacttccactgttcgcgagcaggcagcatccgcgccaatcaccgtcgacttcactggcggacttggtgaatctgatctgaacctggcggaaatggcacgtgcagaagcagctaaggcagctaacgcaccagtggttgaggctccacgcacagtggcagcactgccaactccttaccgaccagtggttcaaaccacccctgatttcgcaggtcaagtcacccaaaaccttgacgagatggtcgtcatcgttggcgccggcgagctcggcccactgggttctgcacgtacgcgtttcgacgccgaactcaacggttccctctccgccgcgggtgtcatcgaacttgcatggacgatgggacttatccactgggatgaagatccaaagccaggctggtacgacgactccgacgacgcagtggccgaagaagacatcttcgaccgctaccacgacgaagtcatggcacgcgttggtgtccgcaagtacaatgacatgcctgagtacggcatgatcgacaactttgcaccagagctgaccaccgtctacctcgaccaggacctcaccttcaacgtgggatcccgcgaagaggcactgacctacgtcgactccgagccagaactcacctttgcttctttcgacgaagcagcaggggagtggaaggtcactcgcaaggcaggctccgcaatccgcgtacctcgccgcatggcgatgacccgcttcgttggtggacaggttcctaaggacttcgacccagctgtgtggggcattccagctgacatggtggacaacctggacaccgtcgcgctgtggaacattgtctgtactgtcgacgccttcctgtccgctggattcaccccagcagagctgcttgcttccgttcacccagcacgcgtgtcctctacccaaggcaccggcatgggcggcatggaatccctccgtggcatctacgtcgaccgcattctggcagagccacgcgccaacgacgttctgcaggaagcactgcccaacgttgttgcagctcacgtcatgcagtcctacgtcggtggctacggacagatgatccacccagtcgcagcttgtgcaaccgcagctgtttctgtggaagaagcactggacaagatccgcatcggcaagtccgacttcgttgtcgcaggtggcttcgatgccctgtccgttgaaggcatcaccggcttcggcgacatggcagcaaccgccgactccgcagagatggaaggcaagggaattgagcaccgcttcttctcccgcgccaacgaccggcgccgcggtggattcatcgaatccgaaggtggcggaaccgtccttctggcacgcggatcactcgcagctgacctgggccttccagtactcggtgtcatcggattcgcagagtcctttgcagatggtgcccacacctccatcccagccccaggcctcggtgcccttggtgctgctcgcgatggtgtggaatctcgccttgcagtagcactgcgttccgtcggtgtctctgctgatgagatctccattatctccaagcacgacacctccaccaacgcgaatgatccaaacgagtccgacctgcacgagcgcatcgcatccgctatcggtcgtgcagacggcaacccgatgtacgtgatttcccagaagtcactcaccggacacgccaagggtggtgcagcagcattccagatgatcggtctcacccaggtcctccgatccggactggtgccagccaaccgcgcactcgactgcgttgacccagtactgtccaagcattcccacctcgtctggctgcgcaagccactagaccttcgtgcgaaggcaccaaaggcaggtcttgttacctcccttggcttcggacacgtctccgctctggttgcgattgttcacccagacgccttctatgaggcagttcgtgtggcacgtggtgctgaggcagctgacgtatggcgcgcatccgcgatcgctcgcgaagaagcaggccttcgtaccatcgtcgccggtatgcacggtggcgtactgtacgaacgcccagtcgagcgcaacctcggtgtccacggagacgcagctaaggaagttgaagctgcagtcctcctggattcccgcgcccgcctagttgacggtgtcctccgcgccgaaggctagttggttattgcgttgagccc

SEQ ID NO: 170 - protein, 913 aa, Corynebacterium glutamicum
FYKDLYARSARGTAALWIVAANLSSYSDIDAIINWVGSEQTTTVNGASKLVKPALVPTLLFPFAAPRVSGSMADAGPQAESQMRLLLWSVERLIAGLAPLGSSINVGHRLHVVIPGSPNRGRFGGDGAYGESKAALDAVVTRWNAEQAAWGAHTSLVHAHIGWVRGTGLMGGNDPLVKAAEEAGVETYSTQEIAEKLLSQATSTVREQAASAPITVDFTGGLGESDLNLAEMARAEAAKAANAPVVEAPRTVAALPTPYRPVVQTTPDFAGQVTQNLDEMVVIVGAGELGPLGSARTRFDAELNGSLSAAGVIELAWTMGLIHWDEDPKPGWYDDSDDAVAEEDIFDRYHDEVMARVGVRKYNDMPEYGMIDNFAPELTTVYLDQDLTFNVGSREEALTYVDSEPELTFASFDEAAGEWKVTRKAGSAIRVPRRMAMTRFVGGQVPKDFDPAVWGIPADMVDNLDTVALWNIVCTVDAFLSAGFTPAELLASVHPARVSSTQGTGMGGMESLRGIYVDRILAEPRANDVLQEALPNVVAAHVMQSYVGGYGQMIHPVAACATAAVSVEEALDKIRIGKSDFVVAGGFDALSVEGITGFGDMAATADSAEMEGKGIEHRFFSRANDRRRGGFIESEGGGTVLLARGSLAADLGLPVLGVIGFAESFADGAHTSIPAPGLGALGAARDGVESRLAVALRSVGVSADEISIISKHDTSTNANDPNESDLHERIASAIGRADGNPMYVISQKSLTGHAKGGAAAFQMIGLTQVLRSGLVPANRALDCVDPVLSKHSHLVWLRKPLDLRAKAPKAGLVTSLGFGHVSALVAIVHPDAFYEAVRVARGAEAADVWRASAIAREEAGLRTIVAGMHGGVLYERPVERNLGVHGDAAKEVEAAVLLDSRARLVDGVLRAEG

SEQ ID NO: 171 - DNA, 2937 bp, Corynebacterium glutamicum
  CDS (101)..(2914): RXN02168
agggtttagtcatctatttcggctacgctcacgtaacctacgcattcgtaagtggtcatgggtccaagaagcccattccaagacttaggagctttatttcgtgagtatttcttcactgacaccgctgcactctttcaaagagccagcaattctgtacgccggtcaggcttctgcctggcagcaggtgatcgctgattccagcgaagaccacatcaccgcaacgcacctgcgcgagctcctgtctcgctcccgtgcaaagactgcacctttcgctcgccaaatcaccgccatcgtgcctggctcacttgctcgtcttgaggaactgacccgcgaagacgcacaaatcggtgcagacatcgacgcacagcctgccgtttccattccaggcattctgctgggacagatcgctgcaacccgtcagctgcgtgacctcggactcgatgtcgcagcagcttcccgccttggacactcccagggcattttgggcgttgaagcagtagacaatgaagaagacgttttagctttcgccatcctgctgggcgcagcagcttcccagttcgctggcaagggcgcacatatgctctctgttcgcggcctgtcccgtgagatcatccaggacaccatcgctggtgtcgatggggtagaggtctccctgcgcaacgctcgtgcacactttgttgtctctggtaagccagaggcactgaagaaggctgctgctgctctacagcgcgcagctgatgtttacaacgaagacatcaacgaaaagcgcaagggtggatccctggcagagcctaagtttgactacttggatgtggccattcctttccaccactcctccatgcaggacgcagccgacttggctgtcgagtgggcaaccacctgtggcctaaacgtcaacgcgcgcgcgttggcagaagcaattctagttaacccagctgactgggttgagcagatcgcaaacctcaaggctgattacgttctttccctcgatgcaggcgtcagccgtttcaccgctccattgctagacggtcgcggaatctctttggttcctgcgttctccgctgcagagcgcgacaacttggctcgccctggcttccacgttcctaccgctgaggattggtccgagttcgctccaaagctggttaagcttccaaacggtgagcacaaggttctcaccgggttctcccgcctgactggttattccccaatcgtcctggctggcatgaccccaaccaccgttgatcctgagatcgttgcagctgcagcgaacgctggacactgggccgaaatggccggtggcggacagtactctgaagaagtcttcaccaagaacaaggaaaagctcgtttccctgctcaaggttggacgctccgcacagttcaactccatgttcttcgaccgctacatgtggaacctgcagttcggtgcacagcgcatcgtttccaaggcacgtgcaaccggtacctccatcaacggtgttgttgtctccgctggtatcccagaggttgaggaagcaactgagctgatcaacgatctgaacgctgatggcttcccatacgttgcattcaagccaggcaccgtggatcagatccgcgcaaccctgaagattgctgatgcaaacccagagaccaagatcatcatccagatcgaggacggacacgctggtggccaccactcctgggtcaacttggacgatctgctcctgaccacctacgcagagctgcgttcccgcaagaacgttgtcgtcatgatcggtggcggcatcggaacccctgcaaaggctgcttactacctgaccggtgaatggtccaccgatttgggcttcccagcaatgccagtggacggcatcctcgtgggtaccgctgccatggcaaccaaggaagcaaccacttctcctcaggtcaagcaggcactggtcgacaccccaggtgttgatccacacgacgctggcggctgggttggccgtggcgatgctcgtggtggcgtgacctctggtctgtcacacctgcacgctgacatgtacgagctggacaacgattctgctgcagcttcccgcctgatctcttccatcgattctgatgattacgcagatcaccgcgaagagctcatcgaggctatcaacaagaccgctaagcctttcttcggcgaggtcgaagagatgacttacgcagagtggatccagcgttgggttgagcttgcttacccaactcaggacccaacctgggatgatcgtttcctcgatttggttcaccgcattgaagctcgtctcaacgaggcagagcacggcgccatcaccacactgttcccagaccatgcgtctgtggaaaatgaggaagaggccgtcgaaaagcttcttgctgcttacccgcaggcccgcgagatccaggtctctgcgcgcgacgccgcgtggtttattggtctgtgccgcaagcaccacaagcctatgccttgggttccagcaatcgatgctgacctagcacgctggtggggccttgacaccctgtggcagtcccagaacgagcgctacggcgcgaactcagtccgcgttatcccaggaccagtctccgtcgccggcatcgaccgtgttgacgagccagttgcagagctgctcggccgcttcgaagctgcctgcgttgacgctctcgacggcgagccagaagagatcttcgctcgcctcaatgagtccaagaacgagcgcgaattcctgctggctaccccacacatcgtgtggcacggcaacctgatcgacaacccagctcacgtcctcaacgagggtgctttcgagctcatcgaggaggatggctactgggtcatccgtatcctggctgattcctacttcgacgatctgccagttgagcagcgcccatacctggttcagcatgttgacatcccagttgagctgggtgacgctggttgaaccggtggtttcccaattgg

SEQ ID NO: 172 - protein, 938 aa, Corynebacterium glutamicum
VSISSLTPLHSFKEPAILYAGQASAWQQVIADSSEDHITATHLRELLSRSRAKTAPFARQITAIVPGSLARLEELTREDAQIGADIDAQPAVSIPGILLGQIAATRQLRDLGLDVAAASRLGHSQGILGVEAVDNEEDVLAFAILLGAAASQFAGKGAHMLSVRGLSREIIQDTIAGVDGVEVSLRNARAHFVVSGKPEALKKAAAALQRAADVYNEDINEKRKGGSLAEPKFDYLDVAIPFHHSSMQDAADLAVEWATTCGLNVNARALAEAILVNPADWVEQIANLKADYVLSLDAGVSRFTAPLLDGRGISLVPAFSAAERDNLARPGFHVPTAEDWSEFAPKLVKLPNGEHKVLTGFSRLTGYSPIVLAGMTPTTVDPEIVAAAANAGHWAEMAGGGQYSEEVFTKNKEKLVSLLKVGRSAQFNSMFFDRYMWNLQFGAQRIVSKARATGTSINGVVVSAGIPEVEEATELINDLNADGFPYVAFKPGTVDQIRATLKIADANPETKIIIQIEDGHAGGHHSWVNLDDLLLTTYAELRSRKNVVVMIGGGIGTPAKAAYYLTGEWSTDLGFPAMPVDGILVGTAAMATKEATTSPQVKQALVDTPGVDPHDAGGWVGRGDARGGVTSGLSHLHADMYELDNDSAAASRLISSIDSDDYADHREELIEAINKTAKPFFGEVEEMTYAEWIQRWVELAYPTQDPTWDDRFLDLVHRIEARLNEAEHGAITTLFPDHASVENEEEAVEKLLAAYPQAREIQVSARDAAWFIGLCRKHHKPMPWVPAIDADLARWWGLDTLWQSQNERYGANSVRVIPGPVSVAGIDRVDEPVAELLGRFEAACVDALDGEPEEIFARLNESKNEREFLLATPHIVWHGNLIDNPAHVLNEGAFELIEEDGYWVIRILADSYFDDLPVEQRPYLVQHVDIPVELGDAG

SEQ ID NO: 173 - DNA, 921 bp, Corynebacterium glutamicum
  CDS (101)..(898): RXN01090
gccggtttgggctggttggagctctagatcgtaagtggtgtcgtacccatgacgtaccattaaccacgaacgttttaaagaagccacgaaggagcctgacatggcgttaccactacccagcaagagcgctcgagcacttgttactggggcaagccaaggcattggcctcgccatcgccaaagatttggcgcggtatgggcacaacctcattttggttgctcgccgcgaggatgtcctcaaagagatcgccgcagatctagagaagaagcacggcgtgatcgttgaggtccgcccggtggatttgagtgatgagccagcccgcaaggtgttgatcgatgagatcaagacaagggaaatcaacatcatcattaactctgctggcatcgcaagctttgggccgttcaaggaccaggattggtcttatgagactgcccagttctcacttaatgccacagccgtttttgagctcacccacgcggtgttgggtggcatgattgaccgtggcacgggcgctatttgcaatgtgggatctgcggctggcaatgtgccaatccccaacaacgccacgtatgtgctcaccaaggctggcgtgaacgcgttcaccgaggcaatgcattatgagctgcgcggaactggtgtggcgtgtactttgctcgcaccgggacctgtccgtgaggcggagatccctgagtctgagaagtcgatcgtggacaaggttgtccctgatttcttgtggaccacctatgagtcctgctccgcagagaccttgcgtgcgctgtctaagaatcagcgtcgcgttgttccaggtccgctgtccaaggccatgaattttgtgtcctctgttgctccaaccgctgtgctctcccctgttatgggctgggtttataagaagatgggttagtttttaaaagtgtctgaatc

SEQ ID NO: 174 - protein, 266 aa, Corynebacterium glutamicum
MALPLPSKSARALVTGASQGIGLAIAKDLARYGHNLILVARREDVLKEIAADLEKKHGVIVEVRPVDLSDEPARKVLIDEIKTREINIIINSAGIASFGPFKDQDWSYETAQFSLNATAVFELTHAVLGGMIDRGTGAICNVGSAAGNVPIPNNATYVLTKAGVNAFTEAMHYELRGTGVACTLLAPGPVREAEIPESEKSIVDKVVPDFLWTTYESCSAETLRALSKNQRRVVPGPLSKAMNFVSSVAPTAVLSPVMGWVYKKMG

SEQ ID NO: 175 - DNA, 1293 bp, Corynebacterium glutamicum
  CDS (101)..(1270): RXN02062
ttgtctaaacatcgttttggggtccgaatgatagccccttttaatgcccccatttcggtatcgctgcgcaactgtttttagatggctaatctttgaaattatgagagtcggaatgatgacaagagagtatccaccagaggtttacggcggcgctggcgtgcacgtcaccgaattgacccgattcatgcgtgagatcgctgaagttgatgttcactgcatgggtgcacctcgcgatatggagggagttttcgtccacggcgtcgatcctgccttggaaagcgcgaaccctgcgattaagacactgtccaccggtttacgcatggcagaagctgcaaacaacgtggatgtcgtgcactcacacacttggtatgcaggtcttggcggccaccttgcagctcgtctccacggcattcctcacgtggctaccgcgcactctttggagccagatcgcccatggaagcgtgagcagcttggcggtggatacgacgtgtcctcctggtctgaaaaaaatgccatggaatacgctgacgcggtcatcgctgtgtcggctcgcatgaaagattccatcctcgctgcgtaccctcgcatcgagccggacaacgtgcgtgttgtcctcaacggcatcgacactgagttgtggcagcctcgcccgactttcgatgacgcggaagattccgtactccgctccctaggcgttgacccacagcggcccatcgtcgcatttgtcggccgcatcacccgccaaaaaggcgtcgagcacctcatcaaggcagcagcgcttttcgacgagtccgtgcagcttgtgctctgtgccggcgcgccagacacccccgaaatcgcagctcgcaccaccgccctggtggaagaactccaggcaaagcgcgaaggcattttctgggttcaggacatgctgggcaaggacaaaatccaagagattctcaccgctgctgacaccttcgtgtgcccatccatttacgagccactgggcatcgtgaacttggaagcaatggcctgcaacaccgcagttgtcgcatccgacgttggaggcatccctgaggttgttgtcgacggcaccaccggcgccctcgttcactacgacgaaaatgatgtcgaaaccttcgagcgcgatatcgccgaagcggtgaataaaatggtcgctgatcgagagaccgcagccaaatttggtctcgcagggcgcgaacgtgctatcaatgatttctcctgggcaacgattgctcagcagaccattgatgtgtacaaatccttgatgtaaaaccgaaagccggggaacct

SEQ ID NO: 176 - protein, 390 aa, Corynebacterium glutamicum
MRVGMMTREYPPEVYGGAGVHVTELTRFMREIAEVDVHCMGAPRDMEGVFVHGVDPALESANPAIKTLSTGLRMAEAANNVDVVHSHTWYAGLGGHLAARLHGIPHVATAHSLEPDRPWKREQLGGGYDVSSWSEKNAMEYADAVIAVSARMKDSILAAYPRIEPDNVRVVLNGIDTELWQPRPTFDDAEDSVLRSLGVDPQRPIVAFVGRITRQKGVEHLIKAAALFDESVQLVLCAGAPDTPEIAARTTALVEELQAKREGIFWVQDMLGKDKIQEILTAADTFVCPSIYEPLGIVNLEAMACNTAVVASDVGGIPEVVVDGTTGALVHYDENDVETFERDIAEAVNKMVADRETAAKFGLAGRERAINDFSWATIAQQTIDVYKSLM

SEQ ID NO: 177 - DNA, 1266 bp, Corynebacterium glutamicum
  CDS (101)..(1243): RXN02148
gcctcagactacggaatccctgtgcaggtggtatctgttgattcagcaccgttttatggtgcgcgtcgctactaagaaatagttcgtcaggagaatctttgtgtctgcatcccgaaaaactctcgttgtgaccaatgattttcctccacggatcggcggaatccaaagctatttgagggatttcatcgctactcaagatcctgagtcgatcgtggtgtttgcgtcgactcaaaacgctgaggaagcgcatgcctacgacaagactttggactatgaggtcattaggtggcctcgttcggtgatgctgcccaccccaacaacggcacacgctatggcggagatcattcgtgagcgagagatcgataatgtgtggttcggtgctgcggctccgttggcgttgatggcaggcacagcgaagcaggcaggtgcgagcaaggttattgcctccactcatgggcatgaggtggggtggtcaatgcttcctggatcgagacaatcgttgcgcaaaatcggcactgaggtggacgtgctgacttatatctcgcagtacacgctgcgcagattcaaaagtgcttttggatcgcacccgacttttgaacatttgccttccggcgtggacgttaagagattcactccggccacgccagaggacaaaagcgcaacaaggaaaaagctaggattcacggacaccaccccggttattgcctgtaactcgcgtttagtgccgaggaaaggccaggactcgctgatcaaggcgatgccacaggtgattgcggcgcgcccagatgcgcagttgctcattgtgggcagtgggcgatacgagtcgactttgcggcgccttgccactgacgtgagccagaacgtgaaattccttgggcgccttgaatatcaagatatgatcaacacgcttgccgccgcagatattttcgcgatgccagcgcgcacccgcggtggcggacttgatgttgaaggcttgggcattgtctatctcgaggcacaagcctgcggagtgccggtgatagccggcacctctggcggcgcgccagagacggtgactccggcaactggcctggttgtggaggggtcggacgtcgataagctgtctgagcttttaattgagcttctcgacgatccgatccgccgcgccgcgatgggcgctgcaggtagggcgcatgtggaggccgaatggtcgtgggaaatcatgggggagcggttgaccaatattttgcagagtgaaccacgatgatggttggacagctgttgata

SEQ ID NO: 178 - protein, 381 aa, Corynebacterium glutamicum
VSASRKTLVVTNDFPPRIGGIQSYLRDFIATQDPESIVVFASTQNAEEAHAYDKTLDYEVIRWPRSVMLPTPTTAHAMAEIIREREIDNVWFGAAAPLALMAGTAKQAGASKVIASTHGHEVGWSMLPGSRQSLRKIGTEVDVLTYISQYTLRRFKSAFGSHPTFEHLPSGVDVKRFTPATPEDKSATRKKLGFTDTTPVIACNSRLVPRKGQDSLIKAMPQVIAARPDAQLLIVGSGRYESTLRRLATDVSQNVKFLGRLEYQDMINTLAAADIFAMPARTRGGGLDVEGLGIVYLEAQACGVPVIAGTSGGAPETVTPATGLVVEGSDVDKLSELLIELLDDPIRRAAMGAAGRAHVEAEWSWEIMGERLTNILQSEPR

SEQ ID NO: 179 - DNA, 1287 bp, Corynebacterium glutamicum
  CDS (101)..(1264): RXN02595
gtgggtaaaggggactccgaggaagtccacgtcgtcttctttcgcggcgctgaggatggtttcgcggatttgtgcgggggagtgggtgggagagaaaacggtgatcgttgtggccatggcttccattatggcttgtttaaaagcagctagactgaataaccctatgaagatccttttgttgtgctggcgtgataccactcatcctcaaggtggcggaagtgaacgctatctggagcgggtgggtgagtttttggcggatcagggccatgaggtggtgtttcgtactgctgggcacacggatgcgccacggcgttctttccgcgatggtgtgaggtattccaggagcggtgggaagtttagtgtgtatcccaaggcgtgggtggccatgatgttgggtcgtgtggggattggcacgttttccaaggttgatgtggtggtggatacgcagaatggcattccgttttttggaaagtttttctccggtaagccgactgtgttgctcacgcatcattgccataaggagcagtggccggtggtgggtcgggtgctggcgaaggttggttggctgattgagagccagatcgcgccgcgcgcttacaaaactgcgccgtatgtgactgtttcagagccgagcgctgaggagctcattgcgttgggtgtggatcagcagcggattcatatcgtgcgcaatggcgtggatcccgtgccgctgcacacgccgaagctggatcgcgatggccagcatgcggtgacgttgtcgcgcctggttccgcacaagcagattgagcatgcgatggatgtcgtcgcggcgctcgacggcgtggtgctggatgtagtcgaaagcggttggtggcagaaggaactggtcgattatgcccgcacgctgggtgtgagcgatcgcgtggttttccacggccaggtcgccgaggatcacaagcacgccctgttggagcgcgccacgattcatctcatgccttcgcgcaaggaaggctggggcctggcggtcacggaggcggcgcagcacggcgttccgacgatcggttaccgaagctcaggcggcctgcgcgattccgtcgtcgacggcgaaaccggcctgcttgtcgactccaaggccgagcttatttcagccaccaaaaccctgcttatcgacgcctccctccgctccaagctcggcgccagcgcgaagcagcgcgccgaaaactacaagtgggacaccgcgggagcgcagttcgaggaactacttcttggtcttgcgtcgaaaaagtagtcccagcggcaacgccatcc

SEQ ID NO: 180 - protein, 388 aa, Corynebacterium glutamicum
VIVVAMASIMACLKAARLNNPMKILLLCWRDTTHPQGGGSERYLERVGEFLADQGHEVVFRTAGHTDAPRRSFRDGVRYSRSGGKFSVYPKAWVAMMLGRVGIGTFSKVDVVVDTQNGIPFFGKFFSGKPTVLLTHHCHKEQWPVVGRVLAKVGWLIESQIAPRAYKTAPYVTVSEPSAEELIALGVDQQRIHIVRNGVDPVPLHTPKLDRDGQHAVTLSRLVPHKQIEHAMDVVAALDGVVLDVVESGWWQKELVDYARTLGVSDRVVFHGQVAEDHKHALLERATIHLMPSRKEGWGLAVTEAAQHGVPTIGYRSSGGLRDSVVDGETGLLVDSKAELISATKTLLIDASLRSKLGASAKQRAENYKWDTAGAQFEELLLGLASKK

SEQ ID NO: 181 - DNA, 2334 bp, Corynebacterium glutamicum
  CDS (101)..(2311): RXS00148
ctttgagggcagcgcgcatgcgcccgatggttatttgaacatgacaattgatgccgcggcgacgctggctgacctgctagatgctttgggagcttaaatcatgacgtcgatccctaatttttcagacatcccattgactgctgagacacgtgcatcggagtcacacaacgttgacgccggcaaggtgtggaacactcccgaaggcattgatgtcaagcgcgtattcacgcaggctgaccgcgacgaggcgcaagcggcgggacatccggtggattctttgccaggtcaaaagccatttatgcgcgggccgtacccaactatgtacaccaatcagccgtggacgattcgccagtacgcaggcttttcaaccgccgcggaatccaatgcgttttatcggaggaaccttgctgcgggtcaaaaaggtttgtcggttgcgttcgatctagcgacccaccgcggttatgactcggataatgagcgcgtggtcggcgatgtgggtatggccggcgtggcgattgattcgattttggatatgcgtcagctgtttgatggcattgatttgtccagcgtgtcggtgtcgatgaccatgaatggcgctgtgctgccgattcttgcgttctatatcgtggcggctgaggaacaaggtgtgggtccggagcagcttgcgggcacgatccagaatgacatcttgaaagaatttatggtgcgcaacacctatatttatccgccgaagccgtcgatgcgcatcatttccaacatctttgagtacacctccttgaagatgccacgttttaactccatttcgatttctggctatcacatccaggaagcgggagcgactgccgatttggagctggcctacactctggcggatggtattgaatacatccgtgcaggtaaagaggtaggccttgacgtggataagttcgcgcctcgtctgtccttcttctggggtatttctatgtacaccttcatggagatcgcaaagctgcgtgcgggacgactgctgtggagcgagttggtggcaaaattcgatccgaaaaacgccaagtcccagtcgctgcgcacgcactcgcagacctctggttggtcgttgaccgcgcaggatgtgtacaacaacgtcgcccgcaccgcgattgaggcgatggctgcaacccagggccacacccagtcgctgcacaccaatgcacttgatgaggcgttggcgctgcccaccgatttctctgctcgtatcgcccgaaacacccagctgttgctgcagcaggaatctggcacggtgcgtccagttgatccatgggcgggctcctattacgtggagtggttgaccaatgagctggctaaccgcgcgcgcaagcacatcgatgaggtggaggaagccggcggaatggcgcaggccaccgcgcagggaattcctaagctgcgcattgaggaatcagcggcacgcacccaggctcgcattgattccggccgccaggcgctgatcggcgtgaatcgctacgtggcggaagaagatgaggaaattgaagtcctcaaggttgacaacaccaaggttcgcgcagaacagttggctaaactcgcgcaactgaaagcagagcgcaacgatgcggaagtcaaggctgcgctggatgcgttgacagctgctgcccgcaacgagcataaagagccaggggatttggatcagaacctgctcaaacttgccgtcgatgctgcgcgcgcaaaagctaccattggagagatctccgatgctttggaagttgtctttggccgccacgaagcagaaatcaggacgctgtctggcgtgtacaaggatgaggttggaaaggaaggcacagtgagcaacgtcgaacgcgcgatcgccctggctgacgcctttgaggctgaggaaggccgccgcccacgtatctttattgccaagatgggccaggatggacatgaccgtggacagaaggttgtcgcgtctgcctatgctgacctgggcatggacgtggatgttggaccgctgtttcaaactccagccgaagctgcccgcgccgccgtggacgccgatgttcacgtggtgggtatgtcttcgctggcagcaggccacctcaccttgctgcccgagctgaagaaagaacttgcagctcttggccgcgatgacattctggtcaccgtgggcggcgtcattccgccgggcgatttccaggatctctacgatatgggtgccgccgcgatttacccttcaggaaccgtcatcgcggagtcggcgatcgatctgatcacccgactcgccgcacacctgggctttgacctggatgtggatgtgaatgaatgatcacggtttcctagaagaca

SEQ ID NO: 182 - protein, 737 aa, Corynebacterium glutamicum
MTSIPNFSDIPLTAETRASESHNVDAGKVWNTPEGIDVKRVFTQADRDEAQAAGHPVDSLPGQKPFMRGPYPTMYTNQPWTIRQYAGFSTAAESNAFYRRNLAAGQKGLSVAFDLATHRGYDSDNERVVGDVGMAGVAIDSILDMRQLFDGIDLSSVSVSMTMNGAVLPILAFYIVAAEEQGVGPEQLAGTIQNDILKEFMVRNTYIYPPKPSMRIISNIFEYTSLKMPRFNSISISGYHIQEAGATADLELAYTLADGIEYIRAGKEVGLDVDKFAPRLSFFWGISMYTFMEIAKLRAGRLLWSELVAKFDPKNAKSQSLRTHSQTSGWSLTAQDVYNNVARTAIEAMAATQGHTQSLHTNALDEALALPTDFSARIARNTQLLLQQESGTVRPVDPWAGSYYVEWLTNELANRARKHIDEVEEAGGMAQATAQGIPKLRIEESAARTQARIDSGRQALIGVNRYVAEEDEEIEVLKVDNTKVRAEQLAKLAQLKAERNDAEVKAALDALTAAARNEHKEPGDLDQNLLKLAVDAARAKATIGEISDALEVVFGRHEAEIRTLSGVYKDEVGKEGTVSNVERAIALADAFEAEEGRRPRIFIAKMGQDGHDRGQKVVASAYADLGMDVDVGPLFQTPAEAARAAVDADVHVVGMSSLAAGHLTLLPELKKELAALGRDDILVTVGGVIPPGDFQDLYDMGAAAIYPSGTVIAESAIDLITRLAAHLGFDLDVDVNE

SEQ ID NO: 183 - DNA, 1971 bp, Corynebacterium glutamicum
  CDS (101)..(1948): RXS00149
ttttcgtaggtaaacacaggtgaaggctttacaagcttgtgaactccctacacaaaagcaatccaatagctatccataagcaagagaaagtaagtctacgttgactgatctcacaaagactgcggtgcccgaggaactttcagagaacctcgaaacttggtacaaggctgtggccggtgttttcgcgcgcacacagaaaaaagacatcggcgacattgccgtagatgtgtggaagaaactcatcgtcactacaccggatggtgttgatatcaatccgctgtacaccagagcagatgagtcccagaggaaattcactgaggttcctggtgagtttcccttcactaggggaaccactgttgatggtgaacgcgttggttggggtgttactgagactttcggacatgacagcccgaagaatatcaacgctgcggtgctgaatgctctgaattctggcaccaccacattgggttttgagttctctgaggaattcacggcagctgatcttaaagttgctctcgaaggcgtgtatctcaacatggctccgttgctgattcatgcgggtggatccacgtcagaggttgcagcggcgttgtatacgttggcggaggaagccggaacgttttttgctgcgttgaccttgggttctcgtcctttgacggcgcaggttgatggttcgcacagtgacaccattgaagaagcagttcagttggcagtgaatgcttccaagcgtgcgaatgtgcgcgctatcttggtggatggttccagtttttccaaccagggcgcgtcggatgctcaagaaattggtctaagtatcgccgccggtgtggattatgtccgtcgcttggtcgatgcaggcctttccacggaagctgcacttaagcaggtggcgttccgttttgcggtcaccgatgagcagttcgcgcagatttctaagctgcgtgtggctcgacgtctgtgggccagggtgtgtgaggtgcttggttttccagagctggccgtagcaccacagcatgcggtgactgcacgagcgatgtttagccagcgtgatccgtgggtgaatatgctgcgcagtactgttgcagctttcgctgcaggcgtcggtggagcaaccgatgtggaggttcgtacttttgatgatgcgatcccagatggagttcctggagtgtcgaggaatttcgctcaccgcatcgcgcgcaatactaatttgttgttgctagaagagtcacatcttggtcacgtggttgatcctgctggtggatcatatttcgtggagagcttcaccgatgatctagcggagaaggcgtgggctgtgttcagtggcatcgaagctgagggcggatacagtgcagcttgtgcatccggcacggtgactgccatgcttgatcagacgtgggagcagactcgcgctgatgtggcgtcgagaaagaagaagctcactggaattaatgagttcccgaacttggcggagtctccgctgccagctgatcgtcgggtagaacctgcaggtgtgcgtcgatgggcagcggattttgaagcgctgcgcaatcgttcggatgctttcttggaaaagaacggcgcgaggccacagatcacgatgattcctctgggaccgttgtccaagcacaatattcgcactggttttacttccaacctgttggcttccggtggcattgaagcaatcaacccgggtcaacttgttcccggcactgacgcttttgcagaagctgcacaggccgcaggcattgtagtggtgtgtggaacggaccaagagtatgccgaaacgggggagggagccgtcgaaaagctccgcgaagcgggcgttgagcgcatcctgcttgctggcgcgccgaagagctttgagggcagcgcgcatgcgcccgatggttatttgaacatgacaattgatgccgcggcgacgctggctgacctgctagatgctttgggagcttaaatcatgacgtcgatccctaa

SEQ ID NO: 184 - protein, 616 aa, Corynebacterium glutamicum
LTDLTKTAVPEELSENLETWYKAVAGVFARTQKKDIGDIAVDVWKKLIVTTPDGVDINPLYTRADESQRKFTEVPGEFPFTRGTTVDGERVGWGVTETFGHDSPKNINAAVLNALNSGTTTLGFEFSEEFTAADLKVALEGVYLNMAPLLIHAGGSTSEVAAALYTLAEEAGTFFAALTLGSRPLTAQVDGSHSDTIEEAVQLAVNASKRANVRAILVDGSSFSNQGASDAQEIGLSIAAGVDYVRRLVDAGLSTEAALKQVAFRFAVTDEQFAQISKLRVARRLWARVCEVLGFPELAVAPQHAVTARAMFSQRDPWVNMLRSTVAAFAAGVGGATDVEVRTFDDAIPDGVPGVSRNFAHRIARNTNLLLLEESHLGHVVDPAGGSYFVESFTDDLAEKAWAVFSGIEAEGGYSAACASGTVTAMLDQTWEQTRADVASRKKKLTGINEFPNLAESPLPADRRVEPAGVRRWAADFEALRNRSDAFLEKNGARPQITMIPLGPLSKHNIRTGFTSNLLASGGIEAINPGQLVPGTDAFAEAAQAAGIVVVCGTDQEYAETGEGAVEKLREAGVERILLAGAPKSFEGSAHAPDGYLNMTIDAAATLADLLDALGA

SEQ ID NO: 185 - DNA, 1179 bp, Corynebacterium glutamicum
  CDS (101)..(1156): RXS02106
ggtcgccgcttttcgacgcccgcctgcggcgggatgactgtgatggaggggcgcgtcgacaagcaaaatctctttagcaaattcggttactgtggggcgcatgaataaccattttgagctcaaagtacctggtggaaagcttgtcgtcgttgatgtgaccaccgatctggattccattgctgacgtgaagatttccggcgatttcttcctcgaacccgatgaggcattcttcgcccttggccgggcgctgcagggggcgtcggtgggtgataacactgatcgtttgcaggcaaagttggatgcagcgttggcggaatatgatgacgttgagctacacggctttagcactgcggatattgctttagctgtgcgtcgggcagtcaccggcgcgcaagatttcaccgattatgaatgggaaatcctgcacccaggggtgcttcctaccccacttaacgttgcgttggatgagctccttttggaccaagttgccagtggtcagcgtggcccgacgatgcgcatttgggattgggatgatcgcgccacagtgatcggtagtttccagtcatatgtcaatgaaatcaaccaagaaggcgttaatgaacatggtgtgaccgtggtacgacgcatgtctggtggcggtgcaatgtttatggagggcggcaactgcatcacctattccctgtatgcaccggaatctctcgttgctggtttgagctatgagcagtcctatgaatatttggatcgttgggtgattgctgcgctgaagacacacgatgttgacgcttggtacgtgcctatcaatgacatcacctccaccggcggaaaaatcggtggcgctgcacagaaacgtcgcagtggcgcagtcctccaccacgtgaccatgtcctatgacatcgatgcggacatgatgacccaggtgttgcgcattggaaaggtgaagatttccgacaagggtcttcgcagcgcaaagaagcgcgttgatcctctgcgccgccaaacaggtgcatcacgtgagcaaatcatcgacaccctaaagtccacattcagtgctaggtacggcgcgcaagaagtagagctcagcgatgaagatttcgcggcaggccacgacctagtaaaaaccaaatacgccaccgaggagtggactaagcgagttcaatagtttctatggatctgcacaag

SEQ ID NO: 186 - protein, 352 aa, Corynebacterium glutamicum
MNNHFELKVPGGKLVVVDVTTDLDSIADVKISGDFFLEPDEAFFALGRALQGASVGDNTDRLQAKLDAALAEYDDVELHGFSTADIALAVRRAVTGAQDFTDYEWEILHPGVLPTPLNVALDELLLDQVASGQRGPTMRIWDWDDRATVIGSFQSYVNEINQEGVNEHGVTVVRRMSGGGAMFMEGGNCITYSLYAPESLVAGLSYEQSYEYLDRWVIAALKTHDVDAWYVPINDITSTGGKIGGAAQKRRSGAVLHHVTMSYDIDADMMTQVLRIGKVKISDKGLRSAKKRVDPLRRQTGASREQIIDTLKSTFSARYGAQEVELSDEDFAAGHDLVKTKYATEEWTKRVQ

SEQ ID NO: 187 - DNA, 876 bp, Corynebacterium glutamicum
  CDS (101)..(853): RXS01746
aaaccgccactcccctttcactggggagtggcggttttgtcgtttcatgcatgcagtgtgtgacttatcaaccttgttagggctagggtggatatctatcatgactgcaccaagagatccttttttccccgcagatctttctatccgcgcgtctgcagagcccattgaaattcagcggttgggtttgatcgattatcaagaggcctgggattatcaagcagagcttgctacccgtagggctaatgatgaaatccctgatcagctgcttattttggagcacccgtcggtgtataccgcaggtaagcgcacccagccggaagatcttcccaccaacggactgccggtgatcaatgctgatcgtggtggtcgcatcacgtggcatggtcctggccaattggtgatctatccgatcatcaaattagccgatccgatcgatgtggttgattacgtaagacgcctcgaggaagcgctcatccaagttgtcggcgatatgggtgttgccggcgctgggcgcattgatgggcgttcgggtgtgtgggtgccagctcatgatggttgggtggacagcaaggttgcggccatcggcattcgaataactcgtggtgttgcaatgcacggtgtggccatcaactgcaacaacacgttggatttctatgagcacatcattccgtgtggcattgctgatgcaggcttgagcacactctcgagggaactgaaaagggacgtttcagttgaggaattagtcgagccatcgatccgcgcattggatgatgctttggctggtcggctggttgtttctgatcattctttcggcagcgcgcccgacccaactaagaatctccctaaacgggggtagtacgaggaattttgtcggtg

SEQ ID NO: 188 - protein, 251 aa, Corynebacterium glutamicum
MTAPRDPFFPADLSIRASAEPIEIQRLGLIDYQEAWDYQAELATRRANDEIPDQLLILEHPSVYTAGKRTQPEDLPTNGLPVINADRGGRITWHGPGQLVIYPIIKLADPIDVVDYVRRLEEALIQVVGDMGVAGAGRIDGRSGVWVPAHDGWVDSKVAAIGIRITRGVAMHGVAINCNNTLDFYEHIIPCGIADAGLSTLSRELKRDVSVEELVEPSIRALDDALAGRLVVSDHSFGSAPDPTKNLPKRG

SEQ ID NO: 189 - DNA, 1167 bp, Corynebacterium glutamicum
  CDS (101)..(1144): RXS01747
cgaagtagagccgattgcagaatcggcggaatgagacgtcgaaaagcgtttaagctttccctaaaaatatcactaactcgaaagatgtaaggttgcatttgtgactatcgcacctgaaggacgacgactgctacgcgtcgaagctcgaaactcagaaaccccgattgagacgaagcctcgatggattagaaaccaggtcaaaaacggacctgagtatcaggatatgaaggaacgtgtcgctggcgcatcactacacactgtgtgtcaggaggctggctgtcctaatatccatgagtgttgggaatcccgtgaggcaaccttcctcattggtggcgccaactgctctcgccgctgtgatttctgcatgatcaactcggctcgccctgagccactcgaccgcggtgagccactgcgtgtcgctgagtctgttcgtgagatgcagctgaattactccaccatcaccggtgttacccgtgatgatctggatgatgaaggcgcatggctgtactcagaagtggttcgtaagatccacgagctgaacccacacaccggtgtggaaaacctggtgcctgatttctccggcaagaaggatctgctgcaggaagtttttgaatcccgcccagaggttttcgctcacaacgtggaaactgtgccacgtattttcaagcgcattcgcccagcattccgctacgagcgttcacttgatgtgatccgtcaggctcgcgatttcggtctggtgaccaagtccaacctgattttgggcatgggtgaaaccaaggaagaaatcaccgaggcgctgcaggatctgcacgacgctggctgtgacatcatcaccatcacccagtacctgcgtcctggtcctttgttccaccccatcgagcgttgggtgaagcctgaggagttcctcgagcacgctgatgctgcaaaggaaatgggcttcgctgctgttatgtccggcccattggttcgttcctcttaccgtgcaggccgtctgtacgcgcaggccatggagttccgtggcgaggaaatcccagcacacctcgcgcacctgaaggatacttccggaggatccaccgcccaggaagcatctacacttctggagcgttacggtgcttccgaagacaccccagtggtgtccttcaactaagcccgaagttttttaaccgc

SEQ ID NO: 190 - protein, 348 aa, Corynebacterium glutamicum
VTIAPEGRRLLRVEARNSETPIETKPRWIRNQVKNGPEYQDMKERVAGASLHTVCQEAGCPNIHECWESREATFLIGGANCSRRCDFCMINSARPEPLDRGEPLRVAESVREMQLNYSTITGVTRDDLDDEGAWLYSEVVRKIHELNPHTGVENLVPDFSGKKDLLQEVFESRPEVFAHNVETVPRIFKRIRPAFRYERSLDVIRQARDFGLVTKSNLILGMGETKEEITEALQDLHDAGCDIITITQYLRPGPLFHPIERWVKPEEFLEHADAAKEMGFAAVMSGPLVRSSYRAGRLYAQAMEFRGEEIPAHLAHLKDTSGGSTAQEASTLLERYGASEDTPVVSFN

SEQ ID NO: 191 - DNA, 903 bp, Corynebacterium glutamicum
  CDS (101)..(880): RXC01748
atcaccaaatgtggcggttttgcgtcgaaaagcgtgctctttctacacctctttgaggttcattttcgcggtttcctcacaatcgcctattgttaagtacatggcagacgcgaaaaagcaggcggataaagccgccaagaagcaggtaagagcagccaagaaggcacagcgcaaggagactcgctcacaaatgtggcaggtcttcaacatgcaacgcaagcaggataaggctcttattccgcttctgttgctcgctattcttggtatcccgctggtccttttcctcatcggtttgatttggggtggtcagtggtggatgcttccgatcggcattgctgcaggtgttgtagctgcaatgtttattttcacccgtcgcgttgagcgtgacgtgtacaagcgcgccgaaggtcagcagggtgctgctggttgggctgtggagaacctccgctctggcgtgggcatgacctggcgcaccaagaccgctgttgcagtgaccactcagatggatgcagtgcaccgcgtcattggtctgtgtggtgttgtgctggtcggcgagggctcccctcaccgcctgaagccaatgcttgcgcagcaaaagaagcgcctgaaccgcgtggcacctggtgttccagtgtatgaaatcatcacgggcaacggcgaaggccagacccctatcgcgaagctgcagcgtgaactggtcaagctgcctcgcaactacaagaagaacgacgtcgctgccctggccgctcgcattgaggctatggacaatgtcggaaacgctcctggcggatctttgcctaagggtccattgccaaagggcgcaagcatgtccggtatgaaccgccgcgctcgccgacaggctgaacgcaagggcgaggcttaaagccttttcgctttcgcgtc

SEQ ID NO: 192 - protein, 260 aa, Corynebacterium glutamicum
MADAKKQADKAAKKQVRAAKKAQRKETRSQMWQVFNMQRKQDKALIPLLLLAILGIPLVLFLIGLIWGGQWWMLPIGIAAGVVAAMFIFTRRVERDVYKRAEGQQGAAGWAVENLRSGVGMTWRTKTAVAVTTQMDAVHRVIGLCGVVLVGEGSPHRLKPMLAQQKKRLNRVAPGVPVYEIITGNGEGQTPIAKLQRELVKLPRNYKKNDVAALAARIEAMDNVGNAPGGSLPKGPLPKGASMSGMNRRARRQAERKGEA

SEQ ID NO: 193 - DNA, 936 bp, Corynebacterium glutamicum
  CDS (101)..(913): RXC00354
ggcttgtcggtaaggctgcagggtagcgggagtttccttcagattggaagttctttaattttctcgattatgtacctcatttacgcgtaaagtttggggcatgggaaagttacttttcgtagacatcggtggcacactgctggattactcaaatgaagttccgcgttcggccgttgacgcgatccgtaaggcacgcgccaaaggacaccgcgtgtacttgagctctggtcgaagcagcgctgaggtgacttctcagttgtgggatatcggagtggatggcctcattggcgcaaatggtggatatgtggaaagcgcacaggagtctgtgttccaccgccgtttgtcgggtgaggagacccgccacattgtggagtggctctacaaccgtggtttggagttttatctcgagtccaacaacggtttgtatgcaagccgtggtttccgtgaggcttctaagccagtgctgtctcgcctttcggagaagaccgacgtgacagtcgatagcatgtacccggatatgttctggggcgcgagccttgatcgtgacgatgtgaacaagatcagttacatcttcaattctcaggaagatttggacgcagcgcgtgaggcgttccctaacctggagcacaccacgtggggtggtcagacgggtgcgttgttcggcacgatcggtgtgtctgtcaacaagaagatcggcgtggatcgcctgctgaagtacctgaacgcagatcgcgcaaacaccattgcgttcggcgacagcgatgaggatctctccctatttgaggcgagcgcttacggcgtcgcgatgggcgaggccaccgaatcgctcaaggctgctgctgacctggtcacggatgctgttgggcaggacggcttgcgcaatgcgtttttaaagcttgagcttatcgacgcctgaccccatcaaagaacttccca

SEQ ID NO: 194 - protein, 271 aa, Corynebacterium glutamicum
MGKLLFVDIGGTLLDYSNEVPRSAVDAIRKARAKGHRVYLSSGRSSAEVTSQLWDIGVDGLIGANGGYVESAQESVFHRRLSGEETRHIVEWLYNRGLEFYLESNNGLYASRGFREASKPVLSRLSEKTDVTVDSMYPDMFWGASLDRDDVNKISYIFNSQEDLDAAREAFPNLEHTTWGGQTGALFGTIGVSVNKKIGVDRLLKYLNADRANTIAFGDSDEDLSLFEASAYGVAMGEATESLKAAADLVTDAVGQDGLRNAFLKLELIDA

SEQ ID NO: 195 - DNA, 1740 bp, Corynebacterium glutamicum
  CDS (101)..(1717): RXC01749
ggtttttgcgtgctctggtttagggactggttttgggaacgtgcccagttccacatcaaataacgctgaggtcgtacttaatccatgagatcatgaatgggtgagcttccttgtagaaaatcaattactcgcgttggttgtcatcatgacggtcggactattgctcggccgcatcaaaattttcgggttccgtctcggcgtcgccgctgtactgtttgtaggtctagcgctatccaccattgagccggatatttccgtcccatccctcatttacgtggttggactgtcgctttttgtctacacgatcggtctggaagccggccctggattcttcacctccatgaaaaccactggtctgcgcaacaacgcactgaccttgggcgccatcatcgccaccacggcactcgcatgggcactcatcacagttttgaacatcgatgccgcctccggcgccggcatgctcaccggcgcgctcaccaacaccccagccatggccgcagttgttgacgcacttccttcgcttatcgacgacaccggccagcttcacctcatcgccgagctgcccgtcgtcgcatattccttggcataccccctcggtgtgctcatcgttattctctccatcgccatcttcagctctgtgttcaaagtcgaccacaacaaagaagccgaagaagcgggcgttgcggtccaggaactcaaaggccgtcgcatccgcgtcaccgtcgctgatcttccagccctggagaacatcccagagctgctcaacctccacgtcattgtgtcccgagtggaacgagacggtgagcaattcatcccgctttatggcgaacacgcacgcatcggcgatgtcttaacagtggtgggtgccgatgaagaactcaaccgcgcggaaaaagccatcggtgaactcattgacggcgacccctacagcaatgtggaacttgattaccgacgcatcttcgtctcaaacacagcagtcgtgggcactcccctatccaagctccagccactgtttaaagacatgctgatcacccgcatcaggcgcggcgacacagatttggtggcctcctccgacatgactttgcagctcggtgaccgtgtccgcgttgtcgcaccagcagaaaaactccgcgaagcaacccaattgctcggcgattcctacaagaaactctccgatttcaacctgctcccactcgctgccggcctcatgatcggtgtgcttgtcggcatggtggagttcccactaccaggtggaagctccctgaaactgggtaacgcaggtggaccgctagttgttgcgctgctgctcggcatgatcaatcgcacaggcaagttcgtctggcaaatcccctacggagcaaaccttgcccttcgccaactgggcatcacactatttttggctgccatcggtacctcagcgggcgcaggatttcgatcagcgatcagcgacccccaatcactcaccatcatcggcttcggtgcgctgctcactttgttcatctccatcacggtgctgttcgttggccacaaactgatgaaaatccccttcggtgaaaccgctggcatcctcgccggtacgcaaacccaccctgctgtgctgagttatgtgtcagatgcctcccgcaacgagctccctgccatgggttatacctctgtgtatccgctggcgatgatcgcaaagatcctggccgcccaaacgttgttgttcctacttatctagcattgaccccttaagcgcag

SEQ ID NO: 196 - protein, 539 aa, Corynebacterium glutamicum
VSFLVENQLLALVVIMTVGLLLGRIKIFGFRLGVAAVLFVGLALSTIEPDISVPSLIYVVGLSLFVYTIGLEAGPGFFTSMKTTGLRNNALTLGAIIATTALAWALITVLNIDAASGAGMLTGALTNTPAMAAVVDALPSLIDDTGQLHLIAELPVVAYSLAYPLGVLIVILSIAIFSSVFKVDHNKEAEEAGVAVQELKGRRIRVTVADLPALENIPELLNLHVIVSRVERDGEQFIPLYGEHARIGDVLTVVGADEELNRAEKAIGELIDGDPYSNVELDYRRIFVSNTAVVGTPLSKLQPLFKDMLITRIRRGDTDLVASSDMTLQLGDRVRVVAPAEKLREATQLLGDSYKKLSDFNLLPLAAGLMIGVLVGMVEFPLPGGSSLKLGNAGGPLVVALLLGMINRTGKFVWQIPYGANLALRQLGITLFLAAIGTSAGAGFRSAISDPQSLTIIGFGALLTLFISITVLFVGHKLMKIPFGETAGILAGTQTHPAVLSYVSDASRNELPAMGYTSVYPLAMIAKILAAQTLLFLLI

SEQ ID NO: 197 - DNA, 1023 bp, Corynebacterium glutamicum
  CDS (101)..(1000): RXA02268
tgaatcgttggtgcttcgagttgggattgttatgtggggagacgtcgataagcaaaacacttgccgagcgcaagccggcctacggcgctagtgtgagcacatgtcccaggaaaattctggtttgttcaagcgcgcgattacacgtggggtggctaaggtgcgccggaatccgcgcgaggattttgcggaggaattcacccaagaactctacgatcacgcaacaaatatcaccctgcccctgacggcgcggctgaagccgaatgggtttttccaggatgattggcgggcgcgaccaagtggtgcgcgaccgtggccgatcgtgctaattcacggatccggggccagcaagggttcatgggaggaaatgggcgctgagctgcgcagcaaaggttgggccgtgtttgcccctgactttggaacgcgtgccaccgagccaattgcggcgtcggctgcccaaattggtgcgtatattgatgccgttttgttggtgacgggcgctgcgcagattgtgctggttgggcattcgcaaggcggtgtcgtggcgcggtattggatgcgcacctacggcggatacatgaaggtcaggcacatgatttccatctctacgccaaatcacggaacgctcatgggaggcattttaaacccgatgacgaaggtgaaatcgggagagggaacgatcgaaaagctgatgcacagactattcgggcccactggttttgaacagctgcgcggacacgacatcatcgagtttttggccgacggtggggacctcgatccaggcgtcacctacacctgcattggtacccattttgatcctttcatccaacctccggaggtggcctttttggaggtcaacgaggacgatgatccaaatcgagtccacaatatttgggtcgaagatgaacacccgcgcgcaatgattgcccacaacgatatggtgcgcgatcccagggtgatcgaaatcgtacgcgcagagctcgaccgggtggcacgcctcggctaagttggggacatggttgacgc

SEQ ID NO: 198 - protein, 300 aa, Corynebacterium glutamicum
MSQENSGLFKRAITRGVAKVRRNPREDFAEEFTQELYDHATNITLPLTARLKPNGFFQDDWRARPSGARPWPIVLIHGSGASKGSWEEMGAELRSKGWAVFAPDFGTRATEPIAASAAQIGAYIDAVLLVTGAAQIVLVGHSQGGVVARYWMRTYGGYMKVRHMISISTPNHGTLMGGILNPMTKVKSGEGTIEKLMHRLFGPTGFEQLRGHDIIEFLADGGDLDPGVTYTCIGTHFDPFIQPPEVAFLEVNEDDDPNRVHNIWVEDEHPRAMIAHNDMVRDPRVIEIVRAELDRVARLG

SEQ ID NO: 199 - DNA, 1095 bp, Corynebacterium glutamicum
  CDS (101)..(1072): RXA02269
cgcaatgattgcccacaacgatatggtgcgcgatcccagggtgatcgaaatcgtacgcgcagagctcgaccgggtggcacgcctcggctaagttggggacatggttgacgccctcaatgatctccgccgagaactcacaaacgcgttaaggtccgtgtggaaaaacctccccactgataacgccccgcaggccgatgccttgccagacgatgtagtggaagagattgcgataaatttctaccgtgatcccaaaaaccgcggcaaactcaacgaagacaaaacagattccttgccgatgctcgcgcgcatacgttcacgtggactttttgaagacgattggcgcgcccgccccaccgaagaccgcccctggccagtggtattagtccacggaactggatcaacaaaaggtgattggcaagacttgggagccgatctacgccgcgacggctgggcagtgtttgcacccgaatttggccaacgcgccaccggttcagtcgcagaatcatccgcacaaattggcgcctatatagatacagtattgcttgctacaggagcctcaaaagtcattgtcgttggccactcccaaggcggcgtgttgctgagatactggatgcgtgttttgggtggtgcatccaaagtcaaacacatggtctccctcgctgtccccaatcacggcaccaccatgggcggaatcgtcagcccgctaatccgtaacaatcgtggcgaaagtgtggttaattctgtcgttcaatcatggttcggcgaagctggatttgaaatgatccgcggacacgacaccatcaacgccatcaatgaaggcggcgatttggatccagacgtgacatatctgtgcatcgccacccactttgacaccgtgattcagccccctgaaacctgcttcctagaggcccggaaccccgaagaactcaagcgggtccaaaacatctgggtggaaaacctcgaccccaattcagtcgtgctccacgaagcaatgccttacgatccccgcgtacgcgcactggtcagggcggatttgagcaaattggtggagatttccgagactgcggagaactaggggttttggtggttgtctaa

SEQ ID NO: 200 - protein, 324 aa, Corynebacterium glutamicum
MVDALNDLRRELTNALRSVWKNLPTDNAPQADALPDDVVEEIAINFYRDPKNRGKLNEDKTDSLPMLARIRSRGLFEDDWRARPTEDRPWPVVLVHGTGSTKGDWQDLGADLRRDGWAVFAPEFGQRATGSVAESSAQIGAYIDTVLLATGASKVIVVGHSQGGVLLRYWMRVLGGASKVKHMVSLAVPNHGTTMGGIVSPLIRNNRGESVVNSVVQSWFGEAGFEMIRGHDTINAINEGGDLDPDVTYLCIATHFDTVIQPPETCFLEARNPEELKRVQNIWVENLDPNSVVLHEAMPYDPRVRALVRADLSKLVEISETAEN

SEQ ID NO: 201 - DNA, 1146 bp, Corynebacterium glutamicum
  CDS (101)..(1123): RXA01614
tgcaattcgcaaacatgagtagtatcgcggaagtttcaccacgtgaacatttcagtcgactcgcgcacaccacaccaacaatcgacctatcgttatacgtatgaatcagatgcagcagtggaaaccagacttcctgggagagggctaccaaaacctcaccatcgagctcggcgacgacccggataatgaaacagatgttgtgacaacggttgtgcgctacaacccagacaatcacgcggacgagtcttttgctgcccgcccagcgttgctgtgggttcacggcatgacggactacttcttccacactgaattcgcggagtttttccacaatgccggttttgctgtgtacggcattgatcttagaaaatgtggacgctcctaccgtccaggacagcagtggcactacacctctgatcttgcccattacttccctgacttaacagctgctgccgaggtcatctcttccacccaccctgagctagtccccgtcgcccattccactggtggactcatcgttcctctgtggatgtcccagatgcgcacaagcaatccagctgccattgagaagattccagcgctggtcctcaacagtccgtggctggacatgatgtatccaccactgttcatcaagctgatcacccctatggtgagggtgttgggcaaacgctcccccacaaccatcatcccaggcggaggtttgggagcatacggaaaatcgatccataagaacttttacggcgaatgggactttgacaccaccatcaagcctgtagaaggacataaaaagagcatcggatggcttcgggcagtcatggctggccaagcagaaatccatcacgaccacgtgaatgtcggagtggacgtgctcacgctgtgttcaaataagtcctggttgaagtctgaatacacagaggacaccaacacttcagacgcggttttggatgtgaaacacattcaaaagtgggctcctcatttgagctcgccatcgtccagggttgatgttgagatcatcgacaacgctcgccacgatattttcctctcaaggaaacccgccagagatcacgcctctgaagtactcaacaactggctgcaatcgaagctttccagcctcaaaccatctcaataacaccgcgaattatagactga

SEQ ID NO: 202 - protein, 341 aa, Corynebacterium glutamicum
MNQMQQWKPDFLGEGYQNLTIELGDDPDNETDVVTTVVRYNPDNHADESFAARPALLWVHGMTDYFFHTEFAEFFHNAGFAVYGIDLRKCGRSYRPGQQWHYTSDLAHYFPDLTAAAEVISSTHPELVPVAHSTGGLIVPLWMSQMRTSNPAAIEKIPALVLNSPWLDMMYPPLFIKLITPMVRVLGKRSPTTIIPGGGLGAYGKSIHKNFYGEWDFDTTIKPVEGHKKSIGWLRAVMAGQAEIHHDHVNVGVDVLTLCSNKSWLKSEYTEDTNTSDAVLDVKHIQKWAPHLSSPSSRVDVEIIDNARHDIFLSRKPARDHASEVLNNWLQSKLSSLKPSQ

SEQ ID NO: 203 - DNA, 630 bp, Corynebacterium glutamicum
  CDS (101)..(607): RXA01983
atatcgctgccatggcagccttgctgggcaacctcaagcacactgacctagaagagctccccaccgattaccaggggtgtcctcccatgtccgctgcgttatggaaggctacggacctacccagatcgaaaagctcttacctgcatacacacaggtcaacacagccgggaataatccagcgacgacgcctgagcaagatctcctcggcggagctgcaacctcgccggaaaactacgaccaccagctgcagtacgcagtcgacgccagtccggtgcatcagaatgcggcacaggcaccgcccttcctgatcatgcacggcactggtgaccggatggtccctccggagcaatcggctgcgctgcacacccatcttgtgcaggctggtcggcagtccaccctggtactcattgagggctttggccacggtttcctcaatcccggggaagtcgcggagctggggccaaacgttcgactagacaatggtcggctcgagcgggagcctcagacaaatttcagcgcgcagcagagtccgggaaacccctttgaactacagggacttgccgccgaccatgagatgatcaagcgctttttcaccctgcaccttcgctaagactctaccttcacccaact

SEQ ID NO: 204 - protein, 169 aa, Corynebacterium glutamicum
MEGYGPTQIEKLLPAYTQVNTAGNNPATTPEQDLLGGAATSPENYDHQLQYAVDASPVHQNAAQAPPFLIMHGTGDRMVPPEQSAALHTHLVQAGRQSTLVLIEGFGHGFLNPGEVAELGPNVRLDNGRLEREPQTNFSAQQSPGNPFELQGLAADHEMIKRFFTLHLR

SEQ ID NO: 205 - DNA, 1414 bp, Corynebacterium glutamicum
  CDS (101)..(1414): RXN02947
gtatgttcacacaagaaccctgcacaacgccttcaaagtacgtcgaccacgaccaagcgcattattcactctcacccttcaggatttagactaagaaaccatgactgcagcacagaccaaacctgacctcaccaccacggctggaaagctgtccgatcttcgctcccgtcttgcagaagctcaagctccaatgggcgaagcaactgtagaaaaagtgcacgctgctggcaggaagactgcccgcgaacgtatcgagtatttgctcgatgagggctctttcgtagagatcgatgctcttgctcgtcaccgttccaagaacttcggcctggatgccaagcgtccagttactgacggtgttgtgactggttacggcaccatcgatggccgtaaggtctgtgtgttctcccaggacggcgctgtattcggtggcgctttgggtgaagtttatggtgaaaagatcgttaaggttatggatcttgcgatcaagaccggtgtgcctttgatcggaatcaatgagggtgctggtgcgcgtatccaggaaggtgttgtgtctctgggtctgtactcacagatcttctaccgcaacacccaggcgtctggcgttatcccacagatctctttgatcatgggtgcctgcgctggtggtcacgtgtactcccctgctctgactgacttcatcgtcatggtggatcagacttccaagatgtttatcaccggccctgatgtcatcaagactgtcaccggtgaagatgtcacccaggaggagctcggtggcgctcacacccacatggctacctccggtacctcccattactctgcttctgatgattcagatgctttggattgggttcgcgagctgacctcttatcttccatccaacaaccgtgcggaaactcctcgccaggaggccgacatcatgatcggttccatccaggaaaacatcaacgatgtggatctggaattggacaccatcatcccggattccccgaaccagccttatgacatgaaggaagttatttcccgcatcgtcgacgacgccgagttcttcgagatccaggaagactacgcagagaacatcctgtgtggcttcgctcgcgttgaggtccgttctgttggcatcgtggctaaccagccaacccagttcgctggctgcttggatattaaggcatctgagaaggctgcccgtttcatccgcacctgcgatgccttcaacatcccaatccttgagttcgtggacgttccaggcttcctgcctggcaccaaccaggaattcgacggcatcatccgccgcggcgcaaagctgctttacgcttacgctgaagcaaccgtcggcaagatcaccgtcatcacccgcaagtcctacggcggagcgtactgcgtgatgggttccaaggatatgggcgctggcctggta

SEQ ID NO: 206 - protein, 438 aa, Corynebacterium glutamicum
MTAAQTKPDLTTTAGKLSDLRSRLAEAQAPMGEATVEKVHAAGRKTARERIEYLLDEGSFVEIDALARHRSKNFGLDAKRPVTDGVVTGYGTIDGRKVCVFSQDGAVFGGALGEVYGEKIVKVMDLAIKTGVPLIGINEGAGARIQEGVVSLGLYSQIFYRNTQASGVIPQISLIMGACAGGHVYSPALTDFIVMVDQTSKMFITGPDVIKTVTGEDVTQEELGGAHTHMATSGTSHYSASDDSDALDWVRELTSYLPSNNRAETPRQEADIMIGSIQENINDVDLELDTIIPDSPNQPYDMKEVISRIVDDAEFFEIQEDYAENILCGFARVEVRSVGIVANQPTQFAGCLDIKASEKAARFIRTCDAFNIPILEFVDVPGFLPGTNQEFDGIIRRGAKLLYAYAEATVGKITVITRKSYGGAYCVMGSKDMGAGLV

SEQ ID NO: 207 - DNA, 688 bp, Corynebacterium glutamicum
  CDS (101)..(688): FRXA02320
gtatgttcacacaagaaccctgcacaacgccttcaaagtacgtcgaccacgaccaagcgcattattcactctcacccttcaggatttagactaagaaaccatgactgcagcacagaccaaacctgacctcaccaccacggctggaaagctgtccgatcttcgctcccgtcttgcagaagctcaagctccaatgggcgaagcaactgtagaaaaagtgcacgctgctggcaggaagactgcccgcgaacgtatcgagtatttgctcgatgagggctctttcgtagagatcgatgctcttgctcgtcaccgttccaagaacttcggcctggatgccaagcgtccagttactgacggtgttgtgactggttacggcaccatcgatggccgtaaggtctgtgtgttctcccaggacggcgctgtattcggtggcgctttgggtgaagtttatggtgaaaagatcgttaaggttatggatcttgcgatcaagaccggtgtgcctttgatcggaatcaatgagggtgctggtgcgcgtatccaggaaggtgttgtgtctctgggtctgtactcacagatcttctaccgcaacacccaggcgtctggcgttatcccacagatctctttgatcatgggtgcctgcgctggtggtcacgtgtactcccctgctctgactgacttcatcgtcatggtg

SEQ ID NO: 208 - protein, 196 aa, Corynebacterium glutamicum
MTAAQTKPDLTTTAGKLSDLRSRLAEAQAPMGEATVEKVHAAGRKTARERIEYLLDEGSFVEIDALARHRSKNFGLDAKRPVTDGVVTGYGTIDGRKVCVFSQDGAVFGGALGEVYGEKIVKVMDLAIKTGVPLIGINEGAGARIQEGVVSLGLYSQIFYRNTQASGVIPQISLIMGACAGGHVYSPALTDFIVMV

SEQ ID NO: 209 - DNA, 519 bp, Corynebacterium glutamicum
  CDS (1)..(519): FRXA02851
  unsure 135: n indicates any nucleotide
  unsure 209: n indicates any nucleotide
  unsure 215: n indicates any nucleotide
  unsure 258: n indicates any nucleotide
  unsure 70: Xaa indicates any amino acid
  unsure 72: Xaa indicates any amino acid
  unsure 86: Xaa indicates any amino acid
cctcgccagaaggccgacatcatgatcggttccatccaggaaaacatcaacgatgtggatctggaattggacaccatcatcccggattccccgaaccagccttatgacatgaaggaagttatttcccgcatcgtngacgacgccgagttcttcgagatccaggaagactacgcagagaacatcctgtgtggcttcgctcgcgttgaggnccgttntgttggcatcgtggctaaccagccaacccagttcgctggctgnttggatattaaggcatctgagaaggctgcccgtttcatccgcacctgcgatgccttcaacatcccaatccttgagttcgtggacgttccaggcttcctgcctggcaccaaccaggaattcgacggcatcatccgccgcggcgcaaagctgctttacgcttacgctgaagcaaccgtcggcaagatcaccgtcatcacccgcaagtcctacggcggagcgtactgcgtgatgggttccaaggatatgggcgctggcctggta

SEQ ID NO: 210 - protein, 173 aa, Corynebacterium glutamicum
  unsure 70: Xaa indicates any amino acid
  unsure 72: Xaa indicates any amino acid
  unsure 86: Xaa indicates any amino acid
PRQKADIMIGSIQENINDVDLELDTIIPDSPNQPYDMKEVISRIVDDAEFFEIQEDYAENILCGFARVEXRXVGIVANQPTQFAGXLDIKASEKAARFIRTCDAFNIPILEFVDVPGFLPGTNQEFDGIIRRGAKLLYAYAEATVGKITVITRKSYGGAYCVMGSKDMGAGLV

SEQ ID NO: 211 - DNA, 1752 bp, Corynebacterium glutamicum
  CDS (101)..(1729): RXN02321
tttaaaaactacccgcacgcagcacgaacctgttcagtgatgtaaatcaccgcggaaatattgtggacgttacccccgcctaccgctacgatttcaaaacatgaccatttcctcacctttgattgacgtcgccaaccttccagacatcaacaccactgccggcaagatcgccgaccttaaggctcgccgcgcggaagcccatttccccatgggtgaaaaggcagtagagaaggtccacgctgctggacgcctcactgcccgtgagcgcttggattacttactcgatgagggctccttcatcgagaccgatcagctggctcgccaccgcaccaccgctttctgcctgggcgctaagcgtcctgcaaccgacggtatcgtgaccggctggggcaccattgatggacgcgaagtctgcatcttctcgcaggacggcaccgtattcggtggcgcgcttggtgaggtgtacggcgaaaagatgatcaagatcatggagctggcaatcgacaccggccgcccattgatcggtctttacgaaggcgctggcgctcgtattcaggacggcgctgtctccctggacttcatttcccagaccttctaccaaaacattcaggcttctggcgttatcccacagatctccgtcatcatgggcgcatgtgcaggtggcaacgcttacggcccagctctgaccgacttcgtggtcatggtggacaagacctccaagatgttcgttaccggcccagacgtgatcaagaccgtcaccggcgaggaaatcacccaggaagagcttggcggagcaaccacccacatggtgaccgctggtaactcccactacaccgctgcgaccgatgaggaagcactggattgggtacaggacctggtgtccttcctcccatccaacaatcgctcctacgcaccgatggaagacttcgacgaggaagaaggcggcgttgaagaaaacatcaccgctgacgatctgaagctcgacgagatcatcccagattccgcgaccgttccttacgacgtccgcgatgtcatcgaatgcctcaccgacgatggcgaatacctggaaatccaggcagaccgcgcagaaaacgttgttattgcattcggccgcatcgaaggccagtccgttggctttgttgccaaccagccaacccagttcgctggctgcctggacatcgactcctctgagaaggcagctcgcttcgtccgcacctgcgacgcgttcaacatcccaatcgtcatgcttgtcgacgtccccggcttcctcccaggcgcaggccaggagtacggtggcattctgcgtcgtggcgcaaagctgctctacgcatacggcgaagcaaccgttccaaagatcaccgtcaccatgcgtaaggcttacggcggagcgtactgcgtgatgggttccaagggcttgggctctgacatcaaccttgcatggccaaccgcacagatcgccgtcatgggcgctgctggcgcagttggattcatctaccgcaaggagctcatggcagctgatgccaagggcctcgataccgtagctctggctaagtccttcgagcgcgagtatgaagaccacatgctcaacccgtaccacgctgcagaacgtggcctgatcgacgccgtgatcctgccaagcgaaacccgcggacagatttcccgcaaccttcgcctgctcaagcacaagaacgtcactcgccctgctcgcaagcacggcaacatgccactgtaaatcggcgaatccataaaggt

SEQ ID NO: 212 - protein, 543 aa, Corynebacterium glutamicum
MTISSPLIDVANLPDINTTAGKIADLKARRAEAHFPMGEKAVEKVHAAGRLTARERLDYLLDEGSFIETDQLARHRTTAFCLGAKRPATDGIVTGWGTIDGREVCIFSQDGTVFGGALGEVYGEKMIKIMELAIDTGRPLIGLYEGAGARIQDGAVSLDFISQTFYQNIQASGVIPQISVIMGACAGGNAYGPALTDFVVMVDKTSKMFVTGPDVIKTVTGEEITQEELGGATTHMVTAGNSHYTAATDEEALDWVQDLVSFLPSNNRSYAPMEDFDEEEGGVEENITADDLKLDEIIPDSATVPYDVRDVIECLTDDGEYLEIQADRAENVVIAFGRIEGQSVGFVANQPTQFAGCLDIDSSEKAARFVRTCDAFNIPIVMLVDVPGFLPGAGQEYGGILRRGAKLLYAYGEATVPKITVTMRKAYGGAYCVMGSKGLGSDINLAWPTAQIAVMGAAGAVGFIYRKELMAADAKGLDTVALAKSFEREYEDHMLNPYHAAERGLIDAVILPSETRGQISRNLRLLKHKNVTRPARKHGNMPL

SEQ ID NO: 213 - DNA, 467 bp, Corynebacterium glutamicum
  CDS (1)..(444): FRXA02321
  unsure 50: n indicates any nucleotide
  unsure 51: n indicates any nucleotide
  unsure 17: Xaa indicates any amino acid
gagtacggtggcattctgcgtcgtggcgcaaagctgctctacgcatcggnngaagcaccggttccaaagatcaccgtcaccatgcgtaaggcttacggcggagcgtactgcgtgatgggttccaagggcttgggctctgacatcaaccttgcatggccaaccgcacagatcgccgtcatgggcgctgctggcgcagttggattcatctaccgcaaggagctcatggcagctgatgccaagggcctcgataccgtagctctggctaagtccttcgagcgcgagtatgaagaccacatgctcaacccgtaccacgctgcagaacgtggcctgatcgacgccgtgatcctgccaagcgaaacccgcggacagatttcccgcaaccttcgcctgctcaagcacaagaacgtcactcgccctgctcgcaagcacggcaacatgccactgtaaatcggcgaatccataaaggt

SEQ ID NO: 214 - protein, 148 aa, Corynebacterium glutamicum
  unsure 17: Xaa indicates any amino acid
EYGGILRRGAKLLYASXEAPVPKITVTMRKAYGGAYCVMGSKGLGSDINLAWPTAQIAVMGAAGAVGFIYRKELMAADAKGLDTVALAKSFEREYEDHMLNPYHAAERGLIDAVILPSETRGQISRNLRLLKHKNVTRPARKHGNMPL

SEQ ID NO: 215 - DNA, 514 bp, Corynebacterium glutamicum
  CDS (101)..(514): FRXA02343
tttaaaaactacccgcacgcagcacgaacctgttcagtgatgtaaatcaccgcggaaatattgtggacgttacccccgcctaccgctacgatttcaaaacatgaccatttcctcacctttgattgacgtcgccaaccttccagacatcaacaccactgccggcaagatcgccgaccttaaggctcgccgcgcggaagcccatttccccatgggtgaaaaggcagtagagaaggtccacgctgctggacgcctcactgcccgtgagcgcttggattacttactcgatgagggctccttcatcgagaccgatcagctggctcgccaccgcaccaccgctttctgcctgggcgctaagcgtcctgcaaccgacggcatcgtgaccggctggggcaccattgatggacgcgaagtctgcatcttctcgcaggacggcaccgtattcggtggcgcgcttggtgaggtgtacggcgaaaagatgatcaagatcatggagctggcaatcgacaccggccgc

SEQ ID NO: 216 - protein, 138 aa, Corynebacterium glutamicum
MTISSPLIDVANLPDINTTAGKIADLKARRAEAHFPMGEKAVEKVHAAGRLTARERLDYLLDEGSFIETDQLARHRTTAFCLGAKRPATDGIVTGWGTIDGREVCIFSQDGTVFGGALGEVYGEKMIKIMELAIDTGR

SEQ ID NO: 217 - DNA, 492 bp, Corynebacterium glutamicum
  CDS (1)..(492): FRXA02850
  unsure 258: n indicates any nucleotide
  unsure 302: n indicates any nucleotide
  unsure 86: Xaa indicates any amino acid
  unsure 101: Xaa indicates any amino acid
gaagagcttggcggagcaaccacccacatggtgaccgctggtaactcccactacaccgctgcgaccgatgaggaagcactggattgggtacaggacctggtgtccttcctcccatccaacaatcgctcctacgcaccgatggaagacttcgacgaggaagaaggcggcgttgaagaaaacatcaccgctgacgatctgaagctcgacgagatcatcccagattccgcgaccgttccttacgacgtccgcgatgtcatngaatgcctcaccgacgatggcgaatacctggaaatccaggcagnccgcgcagaaaacgttgttattgcattcggccgcatcgaaggccagtccgttggctttgttgccaaccagccaacccagttcgctggctgcctggacatcgactcctctgagaaggcagctcgcttcgtccgcacctgcgacgcgttcaacatcccaatcgtcatgcttgtggacgtccccggcttcctc

SEQ ID NO: 218 - protein, 164 aa, Corynebacterium glutamicum
  unsure 86: Xaa indicates any amino acid
  unsure 101: Xaa indicates any amino acid
EELGGATTHMVTAGNSHYTAATDEEALDWVQDLVSFLPSNNRSYAPMEDFDEEEGGVEENITADDLKLDEIIPDSATVPYDVRDVXECLTDDGEYLEIQAXRAENVVIAFGRIEGQSVGFVANQPTQFAGCLDIDSSEKAARFVRTCDAFNIPIVMLVDVPGFL

SEQ ID NO: 219 - DNA, 1671 bp, Corynebacterium glutamicum
  CDS (101)..(1648): RXA02583
cagttgtcgatgaaccagaaatcggcacagtcggagctcatttgagtcgccgcattgatgagatttctcggaagaattagtaacggagagctgacggaagttgagtaacaccactactgcagagaagctagcggatctgcgcgcacgcctggagattgccaaagacccaggtagtgaacgcgcacgtaaaaagcgcgacgaggaaggccgaaccacccctcgtcagcgtattgatgctctgcttgatgccggatcctttgtggagatcggcgcactaggccgtaccccggatgaacccgatgcgccttactctgacggtgtggtgactggttatggtcgcatcgatggtcgcccagtggccatctacgcccatgacaagaccgtttacggtggttccgtgggcatgactttcggacgtaaagtcagcgaagtcatggacatggctatccgcattggttgcccagttatcggtattcaggattccggcggagcccgcattcaggatgcggtgacctccttggcgatgtactcagagatcgcgcgtcgtcagcttccgctgtctggccgcagccctcagatttccatcatgctgggtaaatcggcaggtggcgcagtgtatgcacctgtgaccactgactttgttatcggcgttgatggtgaaacagaaatgtatgtcaccggcccagccgtgatcaaggaagtcaccggcgagcagatcacttccgcagacctcggtggcggtgcgcagcagatgcaaaacggcaacatttcctatttggcgtcctctgaagaagaggccctgaatatggtcaaggatttgctcgacttcctgcctttgacctgcaatgatccagcccctgtgtttgcagcaccaacggatgaagagatcgcctacgacgaagctctgaactcgttcatgcctgacgacactaaccagggctacgacatgcatgacctgctggacaagcttttcgacgacgccaacctgctggaaatccaagaggagtacgcccccaacctgatcactaccttcgcccgcgttgatggcaaggcagtcggtgtggtggccaaccaaccaatggataaggcaggctgcatcgacgctgacgccgccgacaagggcgcccgcttcatccgtatctgcgacgcctacaacatcccgatcatcttcgtcgtggacacccctggctacctgcctggcgtggaccaagagaaggtcggtttgattcaccgtggcgcaaagctagccttcgcagtggtggaatcgaccgtccctaagatttccttgatcgtgcgcaaggcctacggcggagcatatgccgtgatgggttccaagaacctcaccggtgacctcaacttcgcatggccaaccgcacagatcgccgtgatgggcgcagccgcagctgtcgtgatgatccagggcaagcagctcgaagccgccccacctgagcagcgtgaatacatgaagaaactgttcatggacttctacgatgagaacatgaccagcccatatgtggccgccgagcgtggttacatcgacgccatgatcgaacctgcagagacccgtttggtgcttcgccgagcagtccgccagctggaaaccaaggctgtgcgagacctcgacaagaagcacacgatcatgccgatgtaacgtccaaagaattatccaga

SEQ ID NO: 220 - protein, 516 aa, Corynebacterium glutamicum
LSNTTTAEKLADLRARLEIAKDPGSERARKKRDEEGRTTPRQRIDALLDAGSFVEIGALGRTPDEPDAPYSDGVVTGYGRIDGRPVAIYAHDKTVYGGSVGMTFGRKVSEVMDMAIRIGCPVIGIQDSGGARIQDAVTSLAMYSEIARRQLPLSGRSPQISIMLGKSAGGAVYAPVTTDFVIGVDGETEMYVTGPAVIKEVTGEQITSADLGGGAQQMQNGNISYLASSEEEALNMVKDLLDFLPLTCNDPAPVFAAPTDEEIAYDEALNSFMPDDTNQGYDMHDLLDKLFDDANLLEIQEEYAPNLITTFARVDGKAVGVVANQPMDKAGCIDADAADKGARFIRICDAYNIPIIFVVDTPGYLPGVDQEKVGLIHRGAKLAFAVVESTVPKISLIVRKAYGGAYAVMGSKNLTGDLNFAWPTAQIAVMGAAAAVVMIQGKQLEAAPPEQREYMKKLFMDFYDENMTSPYVAAERGYIDAMIEPAETRLVLRRAVRQLETKAVRDLDKKHTIMPM

SEQ ID NO: 221 - DNA, 1635 bp, Corynebacterium glutamicum
  CDS (101)..(1612): RXA00870
caagacggcgatgtcgccgccgctgttgataccgcagcgcgacttgttcacacagatattcaacaattcacttcgcagagcatttaaggaatttacacacatgtctgaaccacaaaccatctcgcactggattgacggcgcgatttccccatccacttccggcaagaccgctcctgtctacaatcctgcaactggccaggtcaccgccaatgttgcgctggctagccaggaagagatcgatgccaccatcgcttctgccaccaaggctgctaagacgtggggcaacctgtctatcgctaagcgccaagctgtgcttttcaacttccgtgagctgctgaatgctcgcaagggtgagctggcggagatcatcactgcagagcacggcaaggtcttgtccgatgccatgggtgaaatcctgcgcggccaggaagtcgtggagcttgctaccggtttcccacacctgcttaaaggtgcgttcaacgagaacgtctccaccggcattgatgtgtattccttgaagcagccactgggtgttgtcggtatcatcagcccgttcaacttccctgcgatggtgccgatgtggtttttcccaatcgcaatcgctgcaggcaacgcagttattttgaagccttcagagaaggatccttcggcagcgctgtggatggctcagatctggaaggaagctggtcttccagacggcgtattcaacgtgctccagggcgacaagctggctgttgatggtttgctgaacagccctgatgtctctgcgatttccttcgtgggttccaccccaatcgcaaagtacatctacgagacttccgcgaagaacggcaagcgcgtccaggcgttgggcggcgcgaagaaccacatgctggtgctgccagatgctgatctggatctggttgccgatcaggcaatcaacgcaggttacggcgctgccggtgagcgttgcatggctgtttctgtggtcttggctattgaatctgttgccgacgagctcattgagaagatcaaggagcgcatcgacaccctgcgcatcggcaacggtgccggcgacgagcagggcgagccgcacctgggcccactaatcaccgacgtccaccgcgacaaggtcgcttcttatgtcgacatcgctgaggccgacggcgccaagatcatcgtggacgggcgtaactgcgccgtagacgggcacgaggagggcttcttcttcggccctacgcttatcgacgacatcccactcacgttccgcgcctacaccgaagaaatcttcggcccggtcctctctgtcgttcgtgtcgcatccttcgacgaggcaattgagctgatcaactccggtgaattcggcaacggaaccgcaatcttcaccaacgatggtggagcggcacgccgcttccagcatgagatcgaagtgggcatgatcggcatcaacgtaccaatcccagtgcctgttgcgtaccactccttcggtggttggaagaactccctcttcggtgacgccaaggcatatggcactcaaggttttgatttcttcaccagggaaaaggcgatcaccagccgttggctcgacccagcaacccacggtggcattaacctcggtttcccacagaacgattaattgaaggagagcacaggact

SEQ ID NO: 222 - protein, 504 aa, Corynebacterium glutamicum
MSEPQTISHWIDGAISPSTSGKTAPVYNPATGQVTANVALASQEEIDATIASATKAAKTWGNLSIAKRQAVLFNFRELLNARKGELAEIITAEHGKVLSDAMGEILRGQEVVELATGFPHLLKGAFNENVSTGIDVYSLKQPLGVVGIISPFNFPAMVPMWFFPIAIAAGNAVILKPSEKDPSAALWMAQIWKEAGLPDGVFNVLQGDKLAVDGLLNSPDVSAISFVGSTPIAKYIYETSAKNGKRVQALGGAKNHMLVLPDADLDLVADQAINAGYGAAGERCMAVSVVLAIESVADELIEKIKERIDTLRIGNGAGDEQGEPHLGPLITDVHRDKVASYVDIAEADGAKIIVDGRNCAVDGHEEGFFFGPTLIDDIPLTFRAYTEEIFGPVLSVVRVASFDEAIELINSGEFGNGTAIFTNDGGAARRFQHEIEVGMIGINVPIPVPVAYHSFGGWKNSLFGDAKAYGTQGFDFFTREKAITSRWLDPATHGGINLGFPQND

SEQ ID NO: 223 - DNA, 1305 bp, Corynebacterium glutamicum
  CDS (101)..(1282): RXA01260
ctaaacgtgggctgcattccttccaaagtctctgatcaaaaacgctgaagttgcccatacctttacccatgagaagaagaccttcggcatcaatggcgaagtgaccttcaactatgaggatgctcacaagcgttcccgtggcgtttccgacaagatcgttggaggcgttcattacttgatgaagaagaacaagatcatcgaaattcatggtcttggaaacttcaaggatgctaagactcttgaggtcaccgacggtaaggatgctggcaagaccatcacctttgatgactgcatcatcgcaaccggttcggtagtcaacaccctccgtggcgttgacttctcagagaacgttgtgtcttttgaagagcagattcttaaccctgttgcgccaaagaagatggtcattgttggtgcaggcgcaattggaatggaattcgcctacgttcttggtaactacggtgtagatgtaaccgtcatcgagttcatggatcgtgtgcttccaaatgaagatgctgaagtctccaaggttattgcaaaggcctacaagaagatgggcgttaagcttcttcctggccatgcaaccactgctgttcgggacaacggtgactttgtcgaggttgattaccagaagaagggctctgacaagacagagactcttactgttgatcgagtcatggtttccgttggtttccgtccacgcgttgagggatttggtcttgaaaacactggcgttaagctcaccgagcgtggcgcaatcgagatcgatgattacatgcgtaccaacgtcgatggcatttacgccatcggtgacgtgaccgccaagcttcagcttgctcacgtcgcagaagcacagggcattgttgccgcagagactattgctggtgcagaaactcagactcttggtgattacatgatgatgccacgtgcaaccttctgcaacccacaggtttcttcctttggttacaccgaagagcaggccaaggagaagtggccagatcgtgagatcaaggttgcttccttcccattctctgcaaacggtaaagcagttggcctggcagaaactgatggtttcgcaaagatcgttgctgatgcagaattcggtgagctgctcggtgcacacctggttggagcaaatgcatcagagctcatcaatgaattggtgcttgctcagaactgggatctcaccactgaagagatctctcgtagcgtccatattcacccaacgctatctgaggcagttaaggaagctgcacacggtatctctggacacatgatcaacttctagaatccacctcgttggccctg

SEQ ID NO: 224 - protein, 394 aa, Corynebacterium glutamicum
VTFNYEDAHKRSRGVSDKIVGGVHYLMKKNKIIEIHGLGNFKDAKTLEVTDGKDAGKTITFDDCIIATGSVVNTLRGVDFSENVVSFEEQILNPVAPKKMVIVGAGAIGMEFAYVLGNYGVDVTVIEFMDRVLPNEDAEVSKVIAKAYKKMGVKLLPGHATTAVRDNGDFVEVDYQKKGSDKTETLTVDRVMVSVGFRPRVEGFGLENTGVKLTERGAIEIDDYMRTNVDGIYAIGDVTAKLQLAHVAEAQGIVAAETIAGAETQTLGDYMMMPRATFCNPQVSSFGYTEEQAKEKWPDREIKVASFPFSANGKAVGLAETDGFAKIVADAEFGELLGAHLVGANASELINELVLAQNWDLTTEEISRSVHIHPTLSEAVKEAAHGISGHMINF

SEQ ID NO: 225 - DNA, 294 bp, Corynebacterium glutamicum
  CDS (101)..(271): RXA01261
gtgggtgtttttcattttcttccactctaaaattaagtatggaaaaccaaccgcacccggatgcacgacaatgacccactaaacacgtatccttgaatgcgtgactgaacattatgacgtagtagtactcggagccggccccggtggctatgtctccgccatccgtgcagcgcagcttggcaagaaggttgctgtaattgagaagcagtactggggtggtgtttgcctaaacgtgggctgcattccttccaaagtctctgatcaaaaacgctgaagttgcccatacctttaccc

SEQ ID NO: 226 - protein, 57 aa, Corynebacterium glutamicum
VTEHYDVVVLGAGPGGYVSAIRAAQLGKKVAVIEKQYWGGVCLNVGCIPSKVSDQKR

SEQ ID NO: 227 - DNA, 555 bp, Corynebacterium glutamicum
  CDS (101)..(532): RXA01136
ccctcgcaacaccgacggtagcctcttggaaatggcgcgcatcgtgcgtgagctttcccgctaggacctgtctactgccttcactttgtgcgaacaccgcatgaccttggattacttcaaggcatccggcactgactatgctttgggattggctgcagagtcggaaggggcacgacgcactggtatcaccggcatggcgagtgcattcaaggagtttgctggttgtggtgagatcgaccttgaagcaaccagggtagaaggtggcctcaaagttagtggaaagcttcgttgggcttccaacttgtgcgaagatccagtgattgtgcctgctgcaaagaccgcagagggcttacaactactgttcgcattgggcgcagaaaccgaaggtgtcaccctcggttcttcacttgctctactcggtttgaacgcaactgcttgcgcttgggtgagctttgaggatgtcttcattcctggggctcagattctaagccacgatttccttaccttgtggcatcggtgcgcccaaccttcgtgatcctacggatctccgaatac

SEQ ID NO: 228 - protein, 144 aa, Corynebacterium glutamicum
MTLDYFKASGTDYALGLAAESEGARRTGITGMASAFKEFAGCGEIDLEATRVEGGLKVSGKLRWASNLCEDPVIVPAAKTAEGLQLLFALGAETEGVTLGSSLALLGLNATACAWVSFEDVFIPGAQILSHDFLTLWHRCAQPS

SEQ ID NO: 229 - DNA, 1140 bp, Corynebacterium glutamicum
  CDS (101)..(1117): RXN00559
cccttcaatccagtctttgacggccaatacggcttgccgggtttccagcggatcaatcctcatgaagcatcagcctagtacgaaccgttaaagtgtccatatgtctgataatccgcatgagaatccccgtgagaatccacaccgctccccagaagtcgtccttcgtttcatggctgcccctactgacgttttgatggctggtagccatggcgttggcggtggccgagtcctggaatggatcgataaggctgcttatgcttgtgctacccagtggtctggaacctactgtgtcactgcttatgttggtcacattcacttcactcgccctattccctctggccacatggtcgaggtgcgttcccgcattgcgatgactggccgttcctccatgcacatcgtgaatgaggtgctttctgcggatcctcgcgatggcaactacacccgtgcgtgtgactgcttggttattttcgtggcgaaggacaccgcaactggtcgcgctaccccagttccttcatttacccctaagaatgaagaagagcagcgcgtgttggaagctgctaactcccgcatcgggctgcgcaaggctattgaagcggagatggaaaagcagacgtacaacggaccttctgaggcccctcgtttgattacccgcttcttggctaagccaacagatatcaactggggtggcaaggtccacggtggcactgccatggaatggatcgatgaggcgggtgctgcgtgcaccatggagtggtctggtaaccacaccgttgcggtttatgctggtggtatccgcttctaccagcccattcagatcggtgacctcattgaggtggacgcccgcatgatgcgtaccgataagcgttccatgcagatgtccatccacgtccgtgccggtgatgctcaccgtggccgtgctgagctagaaaccgctattcacgcaacggtgacctacttaggaattgatgtcgacggagagcctttgcctgcaccacagtttgtgcctcgtacccctgaggatatccagttggctgagcatgcaaacatcctgagggatctgcgtgctgattacaccccaatgccgctgttccagcgcagggttccactgcagatcgactagttagacccgaaaaagccccc

SEQ ID NO: 230 - protein, 339 aa, Corynebacterium glutamicum
MSDNPHENPRENPHRSPEVVLRFMAAPTDVLMAGSHGVGGGRVLEWIDKAAYACATQWSGTYCVTAYVGHIHFTRPIPSGHMVEVRSRIAMTGRSSMHIVNEVLSADPRDGNYTRACDCLVIFVAKDTATGRATPVPSFTPKNEEEQRVLEAANSRIGLRKAIEAEMEKQTYNGPSEAPRLITRFLAKPTDINWGGKVHGGTAMEWIDEAGAACTMEWSGNHTVAVYAGGIRFYQPIQIGDLIEVDARMMRTDKRSMQMSIHVRAGDAHRGRAELETAIHATVTYLGIDVDGEPLPAPQFVPRTPEDIQLAEHANILRDLRADYTPMPLFQRRVPLQID

SEQ ID NO: 231 - DNA, 313 bp, Corynebacterium glutamicum
  CDS (101)..(313): FRXA00559
cccttcaatccagtctttgacggccaatacggcttgccgggtttccagcggatcaatcctcatgaagcatcagcctagtacgaaccgttaaagtgtccatatgtctgataatccgcatgagaatccccgtgagaatccacaccgctccccagaagtcgtccttcgtttcatggctgcccctactgacgttttgatggctggtagccatggcgttggcggtggccgagtcctggaatggatcgataaggctgcttatgcttgtgctacccacgggtctggaacctactgcgtcactgcttatgttggtcacatt

SEQ ID NO: 232 - protein, 71 aa, Corynebacterium glutamicum
MSDNPHENPRENPHRSPEVVLRFMAAPTDVLMAGSHGVGGGRVLEWIDKAAYACATHGSGTYCVTAYVGHI

SEQ ID NO: 233 - DNA, 802 bp, Corynebacterium glutamicum
  CDS (101)..(802): RXA01580
cggtaaacgcctcattaaagtccaatgccatgctcataacactaacagttaaccgtgcggtcaactttgctccctatccttaaaaagcccacagaaaaggatgtataagaatatgcacattgttgcccatcgcggtgcggaagatctgcacctcgaaaacaccatgaccgctttccaggctgccgcgcccgctgacgcttttgagctggatatccacgccaccgctgacaatcaggtcgtcgttatccacgaccgcaccgcagcgcgtgttgccgcgccagattccctgcaccgcgacaccccggttgcgcgcttaagcgccgcgcaaatcaaggagataacgcttatcgacggatcccccgtaccaaccctggaggaagttctactccagacgagcctgccgatccaagtggaaatcaaatctgccggtgcagttccagcagccgcagcattattgcagaaatacccagagcacctggagcgcctgctgttcatcagtttcatcgatgcagcactggtggaaatcgtggatcgactgccagaagctcgcgtgggaatcttgcgcgatgcgtccatggatgatctgcgcattcttgattacatcccgctaaaaaatgtgggcgcgatcttgccctcgtggaaagcactaaacgtggcgtcaattgctgatctacataccaagggaatcaaggttggctgctggacaattcgggatgaaaatgcgtttgggatcgcacaacaagctggcgttgattaccccactgttagcgatccctctcgtttctcgcgccctcccctgctg

SEQ ID NO: 234 - protein, 234 aa, Corynebacterium glutamicum
MYKNMHIVAHRGAEDLHLENTMTAFQAAAPADAFELDIHATADNQVVVIHDRTAARVAAPDSLHRDTPVARLSAAQIKEITLIDGSPVPTLEEVLLQTSLPIQVEIKSAGAVPAAAALLQKYPEHLERLLFISFIDAALVEIVDRLPEARVGILRDASMDDLRILDYIPLKNVGAILPSWKALNVASIADLHTKGIKVGCWTIRDENAFGIAQQAGVDYPTVSDPSRFSRPPLL

SEQ ID NO: 235 - DNA, 882 bp, Corynebacterium glutamicum
  CDS (101)..(859): RXA02677
ttagtgcagtgtatttatttccgttcacgctgcggggctggtggtttggagggatactagagtcgatagcaggtatataaaggccaggagagatgggttcatgaaagtcatcgcgcaccgaggtttatcgtctcgctttcccgaattaacagagtctgcgtttcgggcggctctagagctaccgattcatggaattgaaactgatgtccggctgactaaatgtggcgaagtggttaacgtccatgaccccattgtggatcgcgtgtcgaatggtcgcggtcgggtgtcgcgtttggacttggaatccttgctgagcttgaactttggaaccaaagaaaccccagaaaaagtgcttactttaaacaatctattagatatttttgaggattatccagataagcacctttatatagaaaccaagcacccaatgcgctacgcggtcatgctggaagaagaaatcacaaaaatcttaaaatatcgtgggctgacggaagacccacgcatccacatcatttcttttgcacttcccgcgatgtatcgcatggctcgccttgctccacagcttgatcgcattcatctgcgcaggtcgtgggagcgttggggtaatccgcgcgatgtgcgctgcggtgtacccaccggtttggggttgtcgctggagcgggcgaagatggatccaaggatgattggggcgaaagggttacccacctatcttttcaccgtcgataagcaaaaagacatgctgtgggcgcgcgaacagggcgtcgacatgctcgccaccaattatccggaccgtgcggcggagcttttgaacgcacatcccaagcccgccatgtacgctaatgcgcatggcaaagaagactaagaagaatgaacagctgccgg

SEQ ID NO: 236 - protein, 253 aa, Corynebacterium glutamicum
MKVIAHRGLSSRFPELTESAFRAALELPIHGIETDVRLTKCGEVVNVHDPIVDRVSNGRGRVSRLDLESLLSLNFGTKETPEKVLTLNNLLDIFEDYPDKHLYIETKHPMRYAVMLEEEITKILKYRGLTEDPRIHIISFALPAMYRMARLAPQLDRIHLRRSWERWGNPRDVRCGVPTGLGLSLERAKMDPRMIGAKGLPTYLFTVDKQKDMLWAREQGVDMLATNYPDRAAELLNAHPKPAMYANAHGKED

SEQ ID NO: 237 - DNA, 1428 bp, Corynebacterium glutamicum
  CDS (101)..(1405): RXS01166
accgtacccacagacacaccagaattaacagaaacagactgaaaaacaacatcgctcgacatgcgcgtaatcctaacccgcgcacactaatgtggccgatatgggctacaccaacctcaacgacacacgggtcttgcgcgccgggtcatgtgatgcctggtggcgcacgatgtctccgctagtgcagcagggaagtgaggcagtctttcggcgcatcatgggtctctcgcggcgtcctgatcggaaacctggctttgacgatgtcccacatttcggcgcagctgttcgagttcccggtctaaaacacggcacgttggtcaatgctgcacccttgaaagttttgggcgcacggggcgagcccaaccccgcgagttcgtaccgttttgaatacatcaccggtgattccgcaggtcgagccatcactgcgaccggcgctgtcctcttttccacacgcccctggacaaccggcccgcgtcccgcgatcgccatggctccatccacccaaggcgtcgcacagcactgcgatccctcccacacctgcgccatcggactcaacgcattctatgacaaacccttcgacgcaatcattgcttacgaactccccgtcatcctctggtttctagctcacggacttgacgttgtgttcatcgattacccccgcgaccccgcaaccggcgtccaatactattgcgattccatcgctgcagctaaatcgcttctcgacgccgtcctcgcctccagacaactcggcctttcaccggaagcaccgcttggcctgtggggattctcccaaggaggcggcgccactggctgggctgcacaattgcaggattacgcacctgatgtccgcccaaaggcagcggtcgtgggcgctccaccagtggatctcttccgcgtcttggacactgtcgacggcggattgctcaccggagtgattgcctacgccatcgcgggacttgcagtgaactcttcagagatgtttgaggaaatcatgtcggtgttaaatgaacgcggagtcagtgatgtgctgaaaaatatcaccagctgcgcgggaggttccttgttggccagtggctactcgtcttcccgcgggtggacacatcagggcacgccgctggcagacattctggacgatctgccacttgttgtcgctgagtttgggaagcaaaagctgggtcgtgtggcgccagaaatcccagtgctgttgtggggctctaaaaatgatgatgtcattcccattgatcccattagggaattgcgtgatagctgggcggacaagggtacgccattgacctggcatgaatcccaagcgccgcgtgtgccaggacgcacaggtctcaaccatttcgggccctattttagaaacctggaaaagtactcgggatggctcatagatcatcttgtctgagtgccgttttaaaggctcgg

SEQ ID NO: 238 - protein, 435 aa, Corynebacterium glutamicum
MGYTNLNDTRVLRAGSCDAWWRTMSPLVQQGSEAVFRRIMGLSRRPDRKPGFDDVPHFGAAVRVPGLKHGTLVNAAPLKVLGARGEPNPASSYRFEYITGDSAGRAITATGAVLFSTRPWTTGPRPAIAMAPSTQGVAQHCDPSHTCAIGLNAFYDKPFDAIIAYELPVILWFLAHGLDVVFIDYPRDPATGVQYYCDSIAAAKSLLDAVLASRQLGLSPEAPLGLWGFSQGGGATGWAAQLQDYAPDVRPKAAVVGAPPVDLFRVLDTVDGGLLTGVIAYAIAGLAVNSSEMFEEIMSVLNERGVSDVLKNITSCAGGSLLASGYSSSRGWTHQGTPLADILDDLPLVVAEFGKQKLGRVAPEIPVLLWGSKNDDVIPIDPIRELRDSWADKGTPLTWHESQAPRVPGRTGLNHFGPYFRNLEKYSGWLIDHLV

SEQ ID NO: 239 - DNA, 690 bp, Corynebacterium glutamicum
  CDS (101)..(667): RXA00875
caatttggcggcgctgctgggtgatcgggggccggttgttccgggtgtgattggtgactgggtgaggggctaacgcaacaatgtgtctaagcttaggggcatgactactgaggttgaactggttgttttagctgattccgagggcaatcctattggtactgcgccgaaagctacggtgcacactaaggacacgcctctgcatttcgcgttttccacctatattttgaacccgcgtggggagctgttggtgacgcgtcgtgcattgtcgaagaagacatggcctggtgtgtggacgaactctatgtgtgggcaccctggtccggatgagacaaacgcggatgcgattcgtcgcaggggtgtcgatgagttggggctggaggtagattctttcttggatattcaagagattctgcctgattaccagtaccgtgctgtcgacgcgtccggcattgtggagtgggagttgtgcccggtccacctcgtgcgtttagcggtgggggaatttgtggagccactggatgatgaggtggaggagttcgagtgggcggaaccgcagaagcttttcgacgctgttgatgccacaccatttgtgttttctccatggctagtggatcagcttagcgcccctgagctgcgccaagccatcctggaagcgtttgacgcagagtaactaactagtctagaagcctt

SEQ ID NO: 240 - protein, 189 aa, Corynebacterium glutamicum
MTTEVELVVLADSEGNPIGTAPKATVHTKDTPLHFAFSTYILNPRGELLVTRRALSKKTWPGVWTNSMCGHPGPDETNADAIRRRGVDELGLEVDSFLDIQEILPDYQYRAVDASGIVEWELCPVHLVRLAVGEFVEPLDDEVEEFEWAEPQKLFDAVDATPFVFSPWLVDQLSAPELRQAILEAFDAE

SEQ ID NO: 241 - DNA, 1308 bp, Corynebacterium glutamicum
  CDS (101)..(1285): RXA01292
tccgcgtccctcgaagacttaaaaaacgggcgggattttgtgccgtctttaaaaaagccagcctggcaaccaaagcaatgtggaaagaagtgtttcaaaaatgacaaaagcagtggtcatcggcgggggactagcaggactagccaccaccgcactgctcttacgcgaaggatatgaagtccacctcgtcgaacaaaacgagcacctcggcggccgcgccgggaccttcgaactcgacggcttccgctgggacaccggccccagctggtacctcatgcccgacgccatgtcccacttctttaagctctgcggcacctccatcgacgaccacctcgacctcgtgccacttgaacccgcctaccgcgtcatcgacgaccacggcgaattcatcgacgtcacctccgacatcgatgcgatggccgagcttttcgaatcccgcgaacccggcgccggcgccaaactgcgcacctatatcgactccgccacacaggtctacaacctggccatcgacggcttcctctacaccaacttcaccaacttcatcccatacttaagccccggcatgctgcgccttttacccaaacttctagcaagcctgtcgacctcgctaaaagtcaaggtcaacacccaattccgcgatacaaaactgcgccaaatcttaagctaccccgcagttttcctctcctcagacccttcgcacaccccggcgctctatcacctcatgagccacaccgacctcgtccaaggcgtctcctatccccgaggcggcttcaccgccttcatcaaggcactaatttcgcttatcgacgacgccgtcctccacctcggcacccccgtcagcgcaatcaccacccaaggccgaaacgccacaggcgtccaagtcggctcagagttcatcgaagccgatatcgtgatcagctgcgctgatcagcaccacaccgaaacccaactcctacctgcttcgttgtgcgcgaagccggagacgagctggaagaacaaacaacccggcctcagtactgtgctggttttggcaggcgtgaagggggagcacaccctgctttttcctccgactgggacgaagatttccgcaaagttttcgacggctccaccccagaattcccggcttcagaatccatctagatctccaagacctccgcaacagattccgatgccgcacccgaaggccacgagaacctcttcatcctggtcccagtacccgccgatgtctccattggtcacgggtccgcttacggagaagaatctgacatggtgggccggatcgcaatagcagcagtggctcaaattggg

SEQ ID NO: 242 - protein, 395 aa, Corynebacterium glutamicum
MTKAVVIGGGLAGLATTALLLREGYEVHLVEQNEHLGGRAGTFELDGFRWDTGPSWYLMPDAMSHFFKLCGTSIDDHLDLVPLEPAYRVIDDHGEFIDVTSDIDAMAELFESREPGAGAKLRTYIDSATQVYNLAIDGFLYTNFTNFIPYLSPGMLRLLPKLLASLSTSLKVKVNTQFRDTKLRQILSYPAVFLSSDPSHTPALYHLMSHTDLVQGVSYPRGGFTAFIKALISLIDDAVLHLGTPVSAITTQGRNATGVQVGSEFIEADIVISCADQHHTETQLLPASLCAKPETSWKNKQPGLSTVLVLAGVKGEHTLLFPPTGTKISAKFSTAPPQNSRLQNPSRSPRPPQQIPMPHPKATRTSSSWSQYPPMSPLVTGPLTEKNLTWWAGSQ

SEQ ID NO: 243 - DNA, 450 bp, Corynebacterium glutamicum
  CDS (101)..(427): RXA01293
cgatgccgcacccgaaggccacgagaacctcttcatcctggtcccagtacccgccgatgtctccattggtcacgggtccgcttacggagaagaatctgacatggtgggccggatcgcaatagcagcagtggctcaaattgggcgatgggctggcattgatggtttggaaagccgcattgttgtgcagcgcaccatcggccctgccgacttcgcagaccgatacaactcctggagcggcgggtccattggcccctcacacaccctggcacaatcggcgttctttaggggttctaacaaatcccgcaaagtagatggcctgtatgacgcaggtgacaccacagttccaggggtgggcgtatctatgtgtttgatctctgcagaaaacgtgctcaagcgtctccgcggggacaacagtgtggatcggacttaacgggacttttttcttttgct

SEQ ID NO: 244 - protein, 109 aa, Corynebacterium glutamicum
MVGRIAIAAVAQIGRWAGIDGLESRIVVQRTIGPADFADRYNSWSGGSIGPSHTLAQSAFFRGSNKSRKVDGLYDAGDTTVPGVGVSMCLISAENVLKRLRGDNSVDRT

SEQ ID NO: 245 - DNA, 1386 bp, Corynebacterium glutamicum
  CDS (101)..(1363): RXA02310
gaaatggacaaaaagctttttgtttaaccgtagtcgacggaaggcacttgaagcaccttgggttagtcttcttgctctccggactgagacaatggggtttgtgtctacaacttttgatgtgttgatcatcggcgcgggcccctcaggtgccagcgccgccgtccatgcggccaggactgggcttcaaacattgcttatcgacgcctcctccttcccgcgggataaaacgtgtggcgatggccttactccccgtgcgattcaccagctagaacttctaggtgttgctgatcaggttaccggggattatttcaacaagggcttgaaactgcatggttttggtggctctgttgaggcgccgtggccggagacatatttcacgaataagggttccgcgatgtcgcggatggagttcgatgatttgttattccgcttggcaaaatctcatgaggaagtaaccacgtgggagaacgcgagcgcccaagaccccattttgagggggaatttcttggaaggcgttgtgattaatcacgcagggcaagagaaaaccgtcaaggcgaagcatgtgattattgccgatggtgtccgctcccctttcggtaagaaactgggtaggcagtggcaacgcgatgaggtgtatggcattgcggctcgtgcttattgtgaaactccgctgtctgatgaaccgtggattcactcccatgtggaactgcgcgatgaagatggtgtggtgcagccaggatatgggtggattttcccgctgggcaacggcacggtgaatttgggttgtggcgcgctctcgacggatacgagaccagcgaagatcaatacgaagaaattgttgagcttctatgcgggtcagcgtcgtaaagcatggcaactcgggcccgagcacgacgtcgcctctgccctgctgcctatgggcggcgcggtgtcgaatgtggctggcgcgaactggatgctgatcggcgattccgccgcgtgtgtgaacccgctgaacggcgaaggcatcgactatggcctggaaaccgcggcgatggccgtcgacacgcttgtggaaaaccccaagcgcgatttgaccttggtatggccacataggttgcgcgacgcgtacggcgagaccttcatgttggcgcgcacggctgctcgactgctgacgtacccgcagtttttgccgatggctgggccgctcgcattccgcgggccgctgcaaaaggccatcatgccggcggctgcgcgtttgatgggcaacctgatcacagaggaggataaagacctgctcgccaggggttggcaggccgccggatccgcgattagttgggcgcggaagggctcccctctgtgggactcgactagttctctggtttaatcgccgagtgcagcgcgacg

SEQ ID NO: 246 - protein, 421 aa, Corynebacterium glutamicum
VSTTFDVLIIGAGPSGASAAVHAARTGLQTLLIDASSFPRDKTCGDGLTPRAIHQLELLGVADQVTGDYFNKGLKLHGFGGSVEAPWPETYFTNKGSAMSRMEFDDLLFRLAKSHEEVTTWENASAQDPILRGNFLEGVVINHAGQEKTVKAKHVIIADGVRSPFGKKLGRQWQRDEVYGIAARAYCETPLSDEPWIHSHVELRDEDGVVQPGYGWIFPLGNGTVNLGCGALSTDTRPAKINTKKLLSFYAGQRRKAWQLGPEHDVASALLPMGGAVSNVAGANWMLIGDSAACVNPLNGEGIDYGLETAAMAVDTLVENPKRDLTLVWPHRLRDAYGETFMLARTAARLLTYPQFLPMAGPLAFRGPLQKAIMPAAARLMGNLITEEDKDLLARGWQAAGSAISWARKGSPLWDSTSSLV

SEQ ID NO: 247 - DNA, 1170 bp, Corynebacterium glutamicum
  CDS (101)..(1147): RXA02718
tccaccaaaattcagcccgcatccccctattcgattgaaggacgtctccttgagcagtttcgatgcccatgaccttgacctcgacaaatttccggaggtcgtgcgagatcgtttgacgcagttcctcgatgctcaagagctaacaattgctgatatcggcgctcctgtcacagatgctgtggcccatcttcgcagtttcgtgctcaatggaggaaagcgaatccgtcctctttatgcgtgggctggtttcctggcggcgcaaggccataagaattcttctgaaaaacttgagtccgtccttgacgccgcagcgagtctcgaattcatccaggcttgtgccttgattcatgacgatattatcgattcttctgatacccggcgcggagcccccacagttcaccgggctgtggaagctgatcaccgcgccaataatttcgaaggcgatcccgagcactttggcgtttcagtctcgattttggctggcgatatggcattggtgtgggcagaagacatgctgcaggattccggtttgagtgcagaggcattggcccgcacgagggatgcttggcgtggcatgcgtactgaggttattggcggccagctgcttgatatttatctagagtcgcacgccaacgagtcggtggagcttgcggattctgtcaaccgcttcaaaacggccgcttacacgattgcgcgcccattgcacctgggcgcctccattgctggcggttcgccgcagcttatcgacgcgctcctccactacggccacgacatcggcattgcattccagttgagggatgatctgcttggtgtgtttggggatcccgctatcaccggcaaaccagctggagacgatatccgtgaaggcaagcgcactgttcttcttgcgctcgctctacaacgcgctgataagcaatctcctgaagctgcaacggccattcgcgcaggtgttggaaaggtgacttcaccagaagatattgctgtcattacagagcatattcgagctactggtgctgaagaagaagttgagcagcgaatttcccagctgactgaatccggtttggctcacctcgatgatgtagacatccccgatgaggtgcgcgcacagttgcgggcactggctatccgctcaaccgaacgtcggatgtagtagacgcgtatgacactttt

SEQ ID NO: 248 - protein, 349 aa, Corynebacterium glutamicum
VRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 249 - DNA, 852 bp, Corynebacterium glutamicum
  CDS (101)..(829): RXA01067
ggctttaaggccgaggtgcctggctgaactgcagcccctccagaccctgagatcaggctaaatggcaaacacaaatagtttgcatggcagaatagcttaggtgagtgaattccaagtacccgaaatccctgcccaattcctacccaagcatattgcgcttgtcatggatggaaatggacgctgggctaccgagcgtggcatgaagcgcaccgaaggccataagcgtggcgaggcagtcctgcttgatgttgttgatgcatgcattgaacttggtgttccgtacctttctgcttatgccttctctactgaaaactggcgtcgttccaccgatgaggtccgtttcctcatgggattcaaccgagatgtgctgcgacgacaacgcgatgacctacatgaaaagggcgttcgtgtgcgttgggttggccgtcgtccccgcctgtggcgttcggttatccgtgagctggaaactgcggaagagctaaccaaagacaacaccaccatgaccttggccatgtgtgtgaactatggtggacgcgccgaaatcatcgacgcagcccgcgacatcgcccgccttgcagctgaaggcaaactgcgcccggaacaaatcactgagaagaccttcccgaacttcctcgacgaacctgacatgccagacgtcgacctgttcctgcgcccatccggtgagaagcgcacgtcaaacttcctgctgtggcagtctgcctacgcggaaatggtctaccaagacaagctgttccctgatttcacgcagcaagatctgtacgacgcggtcctggaatacgccaagcgggatcgcagattcggaagcgcataatgcccaccaaccagccgacg

SEQ ID NO: 250 - protein, 243 aa, Corynebacterium glutamicum
VSEFQVPEIPAQFLPKHIALVMDGNGRWATERGMKRTEGHKRGEAVLLDVVDACIELGVPYLSAYAFSTENWRRSTDEVRFLMGFNRDVLRRQRDDLHEKGVRVRWVGRRPRLWRSVIRELETAEELTKDNTTMTLAMCVNYGGRAEIIDAARDIARLAAEGKLRPEQITEKTFPNFLDEPDMPDVDLFLRPSGEKRTSNFLLWQSAYAEMVYQDKLFPDFTQQDLYDAVLEYAKRDRRFGSA

SEQ ID NO: 251 - DNA, 564 bp, Corynebacterium glutamicum
  CDS (101)..(541): RXA01269
gattatctctgcgccgattcagctggcaatagcagcagttgtattgagagctcatggtcgtccgattctatttcgtcaaccacgacctgggaaagacggtgtggtatttgagatgattaagtttcgaaccatgcttgaaccagatgaaaaacatgtaactgatgaacagcgtctaactaaagttggaaagcttctgcgggaaacgagtttagatgagttacctacactctggaatgtatttaaaggtgatatgagccttgtagggcctcgacctttgcttgttagctatctggaacattactcttctgaacaagctcgacgccatgaagttcgtcctgggattactggtttggctcaggtgaatggccgtaatcaaactacttgggatgaacgacttaagttggatgtcgaatatgtggatcgctgtagtttgaaactagatttcaaaatattaatcgccactgtaaaaacagttctttctaaaaagggcattagtaatgaaggtcatgtcacgatgccatccttcattgaagaaagaaaatagcaggtaaaaattttactttc

SEQ ID NO: 252 - protein, 147 aa, Corynebacterium glutamicum
VVFEMIKFRTMLEPDEKHVTDEQRLTKVGKLLRETSLDELPTLWNVFKGDMSLVGPRPLLVSYLEHYSSEQARRHEVRPGITGLAQVNGRNQTTWDERLKLDVEYVDRCSLKLDFKILIATVKTVLSKKGISNEGHVTMPSFIEERK

SEQ ID NO: 253 - DNA, 554 bp, Corynebacterium glutamicum
  CDS (1)..(531): RXA01205
gtatcggcctatccgccggccatcatcgcagcggctctcgtaggaatttgcgcgggagttttgccccataattttgaaccctcgcgaatatttatgggcgattccggctccatgctcatcggcctgctgttggctgcagcatcgacctcagcgtcaggaaaaatcaacatgagcctgtatggcgcagctgattttatcgcattgatctcacccatcatcgttgttctcgccgccgtggccatcccactgctcgacctcgtgatggcagtggttaggcgcgtgggcaggggagcatcacccttttccccggacaaaatgcatctgcaccaccgactgctgtccatcggacacacccataggcgcgtggtcctagtgctctacacctgggcgagcgccgtggcattcggcgcagtgagcttctccgtcgttccgccactgtttgccaccggatcgagcatctgtggcatcctcatcgccgtcgctgtcacagccgtgccagtgatgaaaagccggcgagccgccaaacttgattaagtgattgtcactttggattg

SEQ ID NO: 254 - protein, 177 aa, Corynebacterium glutamicum
VSAYPPAIIAAALVGICAGVLPHNFEPSRIFMGDSGSMLIGLLLAAASTSASGKINMSLYGAADFIALISPIIVVLAAVAIPLLDLVMAVVRRVGRGASPFSPDKMHLHHRLLSIGHTHRRVVLVLYTWASAVAFGAVSFSVVPPLFATGSSICGILIAVAVTAVPVMKSRRAAKLD

SEQ ID NO: 255 - DNA, 882 bp, Corynebacterium glutamicum
  CDS (101)..(859): RXA01576
atcggtgatctttcgcgattgatacgtgcgcgattgcgtgcccgccagctgctcaagatcaatggatttcatgacaatcaagttatcatcactggggtcggtggcacctaacaggaaaatcagccatcatgcactaggctctattcctatcatggatgcatcaaaaaacagcgactttaaagacacctggctagtcgtaccttgttataacgaggcaacagttatccgggaagttttagagaacgcactcaaaacattccctaatattgttgcggtcaacgatggctccccggacaactccgcggaagaaatccatgcggccggcgcacacctggtcaaccaccccgtgaacctcggacaaggtgccgcgatccaaaccggcatcgaatacgcccgcaagcaacccggtgcaaaatactttgtaactttcgacgccgacggccaacaccaagtgaaagacgttatccgcatggtggagcgactgcgtgccgaggacgtggacattatcgtcggcacgcgttttggacgcccacgccaagccgatgaccaggtgccactaatcaagcgccttgtgctgcgcaccgtggtcctgctgtcaccgaaaacccgccgacttgggctcaccgacgcccacaacggcctgcgcgtattcaaccaaaaagtggcgcaggaaatgaacatccgcatgaacggcatgtcgcatgcatccgaaatcgtcgaccaaatcgatgaacgcggctggcgcatttcagaagaacccgtagacatcctctacaccgaatactccatgagcaaggggcaatccctgctcaacggcgtaaacatcctggccgacggcttcctagcgaggagactcccatgacgcagaccaccacccaaatc

SEQ ID NO: 256 - protein, 253 aa, Corynebacterium glutamicum
VAPNRKISHHALGSIPIMDASKNSDFKDTWLVVPCYNEATVIREVLENALKTFPNIVAVNDGSPDNSAEEIHAAGAHLVNHPVNLGQGAAIQTGIEYARKQPGAKYFVTFDADGQHQVKDVIRMVERLRAEDVDIIVGTRFGRPRQADDQVPLIKRLVLRTVVLLSPKTRRLGLTDAHNGLRVFNQKVAQEMNIRMNGMSHASEIVDQIDERGWRISEEPVDILYTEYSMSKGQSLLNGVNILADGFLARRLP

SEQ ID NO: 257 - DNA, 1173 bp, Corynebacterium glutamicum
  CDS (101)..(1150): RXN02309
gtgccttccgtcgactacggttaaacaaaaagctttttgtccatttcactggattcaccgaaagaatgaatccacactcgatcaccaaaggtagcgatgaatgagtagcggccgaaccgttccaacccgttcccacgggctcggaaaagaaggtgtatccaccacaggagcatctcaggtcgagtttggtgatcccgagctaacggccaggatcaatgacgccatggtgcaggtagaagaactcctgcacactgaactatcgtccggggaagacttcctcgtcgatatcgtcatgcacctaacacgagccggcggcaaacgattccgccccatgtttgcactgctggcctccgagttcggtgaaaaaccactctccgaaaacgtcatcaaagccgccgttgtcgtagagatcacccacctggccaccctgtaccacgacgatgtcatggacgaggcatccatgcgccgcggcgtcccaagtgctaacgcgcgatgggacaactccgtagccatcctcgcaggcgacatcctcctagcacatgcatcaggtctgatgagtcagctgggtaccgacacagtcgcccactttgccgaaacattcggcgaactagtcaccggccaaatgcgcgaaacagtcgggccacgcgacaccgacccgatcgagcactacaccaacgtaatccgtgaaaaaactggtgtcctcatcgcctccgcaggctatttgggagccatgcacgcaggcgccgcacctgaacacatcgacgccctgaagaacttcggcgcagccgtcggcatgatcttccaaatcgtcgacgacatcatcgacatcttctcggaaacccacgaatccggaaaaacgcccggcaccgacctccgcgaaggtgtattcaccctcccagtgctctacgcactccgtgaagacacccccgtcggcgcagaactccgcgacatcctcaccggccctctagaagacgacgagaccgtcaaccacgtcctcgagctcctctcccaatccggcggacgccaagcagccctcgacgaggtctaccgctacatggacatcgccaacgcagaactcgaccgcctcccagacagcaccgtcaaggaagccctccgcaaccttgcaaccttcacagtcaagcgcgtcggataaccccgtaatccaccacttaa

SEQ ID NO: 258 - protein, 350 aa, Corynebacterium glutamicum
MSSGRTVPTRSHGLGKEGVSTTGASQVEFGDPELTARINDAMVQVEELLHTELSSGEDFLVDIVMHLTRAGGKRFRPMFALLASEFGEKPLSENVIKAAVVVEITHLATLYHDDVMDEASMRRGVPSANARWDNSVAILAGDILLAHASGLMSQLGTDTVAHFAETFGELVTGQMRETVGPRDTDPIEHYTNVIREKTGVLIASAGYLGAMHAGAAPEHIDALKNFGAAVGMIFQIVDDIIDIFSETHESGKTPGTDLREGVFTLPVLYALREDTPVGAELRDILTGPLEDDETVNHVLELLSQSGGRQAALDEVYRYMDIANAELDRLPDSTVKEALRNLATFTVKRVG

SEQ ID NO: 259 - DNA, 1075 bp, Corynebacterium glutamicum
  CDS (101)..(1075): FRXA02309
gtgccttccgtcgactacggttaaacaaaaagctttttgtccatttcactggattcaccgaaagaatgaatccacactcgatcaccaaaggtagcgatgaatgagtagcggccgaaccgttccaacccgttcccacgggctcggaaaagaaggtgtatccaccacaggagcatctcaggtcgagtttggtgatcccgagctaacggccaggatcaatgacgccatggtgcaggtagaagaactcctgcacactgaactatcgtccggggaagacttcctcgtcgatatcgtcatgcacctaacacgagccggcggcaaacgattccgccccatgtttgcactgctggcctccgagttcggtgaaaaaccactctccgaaaacgtcatcaaagccgccgttgtcgtagagatcacccacctggccaccctgtaccacgacgatgtcatggacgaggcatccatgcgccgcggcgtcccaagtgctaacgcgcgatgggacaactccgtagccatcctcgcaggcgacatcctcctagcacatgcatcaggtctgatgagtcagctgggtaccgacacagtcgcccactttgccgaaacattcggcgaactagtcaccggccaaatgcgcgaaacagtcgggccacgcgacaccgacccgatcgagcactacaccaacgtaatccgtgaaaaaactggtgtcctcatcgcctccgcaggctatttgggagccatgcacgcaggcgccgcacctgaacacatcgacgccctgaagaacttcggcgcagccgtcggcatgatcttccaaatcgtcgacgacatcatcgacatcttctcggaaacccacgaatccggaaaaacgcccggcaccgacctccgcgaaggtgtattcaccctcccagtgctctacgcactccgtgaagacacccccgtcggcgcagaactccgcgacatcctcaccggccctctagaagacgacgagaccgtcaaccacgtcctcgagctcctctcccaatccggcggacgccaagcagccctcgacgaggtctaccgctacatggacatcgccaacgcagaa

SEQ ID NO: 260 - protein, 325 aa, Corynebacterium glutamicum
MSSGRTVPTRSHGLGKEGVSTTGASQVEFGDPELTARINDAMVQVEELLHTELSSGEDFLVDIVMHLTRAGGKRFRPMFALLASEFGEKPLSENVIKAAVVVEITHLATLYHDDVMDEASMRRGVPSANARWDNSVAILAGDILLAHASGLMSQLGTDTVAHFAETFGELVTGQMRETVGPRDTDPIEHYTNVIREKTGVLIASAGYLGAMHAGAAPEHIDALKNFGAAVGMIFQIVDDIIDIFSETHESGKTPGTDLREGVFTLPVLYALREDTPVGAELRDILTGPLEDDETVNHVLELLSQSGGRQAALDEVYRYMDIANAE

SEQ ID NO: 261 - DNA, 1767 bp, Corynebacterium glutamicum
  CDS (101)..(1744): RXN00477
tgcgggagcgaatcagagttccacttcatatcaaactctctacactcgctagagccacgatgaaaggtctatctatgagcatctacagaaagaattcgtgatgaaggtctcgactaaaactccacgctcctcaggtaccgccgtagtcataggcgcaggtgttgctggtttagccacttctgcacttttagcacgtgatggctggcaagtaactgttttggaaaaaaatactgatgtcggtggccgagctggatcgcttgaaatatcaggctttcctggctttcgatgggataccggaccttcttggtacctcatgcccgaggcctttgaccatttcttcgcactttttggtgcatgtacttctgattatctcgatttggtagaattaacgcctggttatcgagttttttctggcacacatgacgctgtcgatgtccccactgggcgtgaagaagcaattgcgctattcgaatccatcgaacccggcgcgggtgcaaaactaggaaattatcttgatagcgcggcagacgcctatgacattgccattgatagattcctttataataatttctccacgttaggcccgctgcttcaccgggatgtactgacccgagctggccgactgttttctctactgacccgttctttacaaaagtacgtaaatagtcaattcagtagcccggtgttgcgccagatcctaacctatccagcagtcttcctgtcttcccgacccactactaccccatcgatgtaccacttgatgagtcataccgatttggtgcagggagtgaaataccctataggtggttttactgcagtggttaacgctctgcatcagttagcgctggaaaacggggttgagtttcaactcgattctgaggtcatttccatcaacactgcttcatcgaggggcaacacaagcgccacaggtgtgagcttgcttcacaacagaaaagtgcaaaatctagatgcggatcttgtggtttcagcaggcgacctacaccatacagaaaataatctgcttccccgggaacttcgaacctatcccgaacgatattggtccaatcgcaatcctggaattggagcggtattaatcctcctgggcgtaaaaggagagttaccccagctcgaccatcacaaccttttcttcagtgaagattggacagatgattttgctgtagttttcgacgggcctcaacttacccgcccccacaatgcatcaaattccatttatgtctccaagccttcaacgtccgaagacggcgttgcacctgctggatacgaaaacctttttgttttaattccgaccaaggcctctagcagcatcggccacggtgatgcgtatatgcagtcggcttcagcatccgtggaaacaatcgcgtcacatgcaatcaatcaaattgctacgcaagccggcatccctgacctcactgaccgaattgtggtcaaacgcaccattggccctgcggattttgagcaccgctaccattcatgggtaggcagtgcgctgggtccagcacataccctcagacagtccgctttcttaagagggcgcaatagctcccgcaaggtcaataacctcttctattccggtgccaccaccgtcccgggtgtaggaatacccatgtgtttaatttctgccgagaatattattaagcgtttacatgccgataccagtgcaggaccactgcccgaaccattgccgcctaaaacgacaccatctcaaaagacctcatacgatcattaaattttgatccctatcatcga

SEQ ID NO: 262 - protein, 548 aa, Corynebacterium glutamicum
MKVSTKTPRSSGTAVVIGAGVAGLATSALLARDGWQVTVLEKNTDVGGRAGSLEISGFPGFRWDTGPSWYLMPEAFDHFFALFGACTSDYLDLVELTPGYRVFSGTHDAVDVPTGREEAIALFESIEPGAGAKLGNYLDSAADAYDIAIDRFLYNNFSTLGPLLHRDVLTRAGRLFSLLTRSLQKYVNSQFSSPVLRQILTYPAVFLSSRPTTTPSMYHLMSHTDLVQGVKYPIGGFTAVVNALHQLALENGVEFQLDSEVISINTASSRGNTSATGVSLLHNRKVQNLDADLVVSAGDLHHTENNLLPRELRTYPERYWSNRNPGIGAVLILLGVKGELPQLDHHNLFFSEDWTDDFAVVFDGPQLTRPHNASNSIYVSKPSTSEDGVAPAGYENLFVLIPTKASSSIGHGDAYMQSASASVETIASHAINQIATQAGIPDLTDRIVVKRTIGPADFEHRYHSWVGSALGPAHTLRQSAFLRGRNSSRKVNNLFYSGATTVPGVGIPMCLISAENIIKRLHADTSAGPLPEPLPPKTTPSQKTSYDH

SEQ ID NO: 263 - DNA, 1767 bp, Corynebacterium glutamicum; identical to SEQ ID NO: 261
  CDS (101)..(1744): FRXA00477

SEQ ID NO: 264 - protein, 548 aa, Corynebacterium glutamicum; identical to SEQ ID NO: 262

SEQ ID NO: 265 - DNA, 954 bp, Corynebacterium glutamicum
  CDS (101)..(931): RXA00478
accagaagcagcctcagctatgacacaccaaaattcgcctctcttccttaaaagtgcactgagactttacaatcgggcctcattcaaggcttcacataaagtgatcgaagaatattccacgagcttcagtctgtctacgtggttgctatccccacgcatacgaaatgacatacgaaatctctatgcagtagttcgtatcgccgatgagattgtcgacggcactgcacatgccgctggttgctcaactgccaaaatcgaagagattctcgatgcctatgaaattgcggttcttgcagcaccacaacaacgcttcaacacagatcttgttttacaagcttatggtgaaactgcccgacgctgtgatttcgaacaagagcatgtaatagccttctttgcatcaatgcgtaaggacctcaaagctaatacacacgacccagatagcttcacaacgtatgtctatggctccgcggaagttataggcctgctttgtctcagcgttttcaaccaaggtagaacgattagcaaaaaacggctagagattatgcaaaacggagcccgctcattgggagcggcattccagaaaattaactttctccgtgacttggcagaagatcagcaaaatttgggccgattttatttccccaaaaccagccaaggaactcttactaaagaacaaaaagaagatctcatcgctgatatccgtcaagacctagcaattgcccacgatgcatttccagaaataccagtgcaggctcgcatcggagtgatctctgcttatttgctctttcaaaaactcactgaccgaattgaggctactcctaccgccgatttattgcgggagcgaatcagagttccacttcatatcaaactctctacactcgctagagccacgatgaaaggtctatctatgagcatctacagaaagaattcgtgatgaaggtctcgactaaaact

SEQ ID NO: 266 - protein, 277 aa, Corynebacterium glutamicum
VIEEYSTSFSLSTWLLSPRIRNDIRNLYAVVRIADEIVDGTAHAAGCSTAKIEEILDAYEIAVLAAPQQRFNTDLVLQAYGETARRCDFEQEHVIAFFASMRKDLKANTHDPDSFTTYVYGSAEVIGLLCLSVFNQGRTISKKRLEIMQNGARSLGAAFQKINFLRDLAEDQQNLGRFYFPKTSQGTLTKEQKEDLIADIRQDLAIAHDAFPEIPVQARIGVISAYLLFQKLTDRIEATPTADLLRERIRVPLHIKLSTLARATMKGLSMSIYRKNS

SEQ ID NO: 267 - DNA, 1056 bp, Corynebacterium glutamicum
  CDS (101)..(1033): RXA01291
aacccgcagcgggtggagcggggctgagggagacgtcgagaagcgtccctttcggttgtctggatttctcgcggtaaagtttcctgtgaaggaggcgagtgtggctgatcagcaagattttttgggccgttttgatgcgatgagctcaaaggcgacggccacggtaatcgcccattattcctccagttttactctggcatcgaagctgttgtcgccgaaaattcgtcgcgatattgaggcattgtacgcaatggtgcgagtggccgatgaggttgtggacggcgctgctgctgccgcggggtgtgcgccggacgccgttgcggagattttggacaattacgaacgccaggttctgctcagtttgtccgttccttttcataccgatccagtgatccatgcgtttggcaataccgcccgcaaatgtggttttgagcaggctcacatcgtggcgttttttgattccatgcgccgcgatctctcccaaacctcctatgatccgactcagttggatgagtacatttacggctccgctgaggtcatcgggttgatgtgtttgaaaattttcctccaagattccactgccagcccgcaggatcgggccacgatggaacacggcgccaggcgtttgggtgcggcatttcaaaaggtaaatttcctgcgagatctagctgaagaccgcgaaggcctaggccgttcttatttgccggtattcaccgaagaaatgcgcgatgagatcgttactgatatccgagaggatttggatgccgcccggctgagcattccgctgctgccatttggcgcgcgaaccggtgtgcgcgccgcgaccgatctctacggttgcctcgtggacaacctggaatccgcgtccctcgaagacttaaaaaacgggcgggattttgtgccgtctttaaaaaagccagcctggcaaccaaagcaatgtggaaagaagtgtttcaaaaatgacaaaagcagtggtcatcggcgggggactagcaggactagccaccaccgcactgctcttacgcgaaggatatgaagtccacctcgtcgaacaaa

SEQ ID NO: 268 - protein, 311 aa, Corynebacterium glutamicum
VADQQDFLGRFDAMSSKATATVIAHYSSSFTLASKLLSPKIRRDIEALYAMVRVADEVVDGAAAAAGCAPDAVAEILDNYERQVLLSLSVPFHTDPVIHAFGNTARKCGFEQAHIVAFFDSMRRDLSQTSYDPTQLDEYIYGSAEVIGLMCLKIFLQDSTASPQDRATMEHGARRLGAAFQKVNFLRDLAEDREGLGRSYLPVFTEEMRDEIVTDIREDLDAARLSIPLLPFGARTGVRAATDLYGCLVDNLESASLEDLKNGRDFVPSLKKPAWQPKQCGKKCFKNDKSSGHRRGTSRTSHHRTALTRRI

SEQ ID NO: 269 - DNA, 1239 bp, Corynebacterium glutamicum
  CDS (101)..(1216): RXA00480
tttatggacccaaattcacactttctgtacttcatcaaaataaagcgccatatacaacgattgggaatttttgcgagataactggccgtgtgatactcgaatggacaatggcatgacaatcaccacagaacattcaactcatcctgatcttgatttcaatgatgagatttatcgggaactaaaccgcatctgcgcttcgctatctcaacagtgcagcacatatcaaccagagttccgtacctgcctagatgctgctttccaagctttgcgaggtggcaagttaatccgccctcgaatgctactggggctatacaacacgcttgtagacgatgacattgaggtcaaactcaacaccgttttacaggtagcagtggctttagaactactgcatttttcccttttggttcatgacgatgttattgacggagacctctatcgccgaggcaaacttaattttattgggcagattctcatgcatcgcacacctgaaagttttgcacaaatccagcgcgatccagagcatctagattgggcacaatctaatggactgcttatgggaaatctttttcttgctgccacccatcaaatcttcgcgcgccttgaccttccacatcaccaacgggttcgacttttagatttactcaaccacacgataaatgacactattgtgggtgagtttcttgatgtgggattaagcagcaaagccatcagccccaatatggacattgctctagaaatgagtcggctaaaaacagccacatacacttttgaacttccaatgagagcagcggcaattctcgcggaactacctcaggagattgaaacaaagataggtgagataggcacaaacttgggcatcgcttatcaattgcaggacgattacttatctacttttggtgacgcagccgaacacggcaaagatgccttttctgaccttcgagaaggaaaagaaactacaattatcgccttcgctcgagatactgctaaatggactgatattcaagacaacttcggctccgcagatctgagcacctctcaggcagagcgaattcaacatcttctcatacagtgtggagcaaagaatcactccttgaatgccatctccgaccacttaaatatctgccgttcgatgatcaaaacactaagcccccaggtagatcccaaggctcaaaatttattacttaaacaagttgagcaactagccagccgcaaatcttagaactaacctttacgccttta

SEQ ID NO: 270 - protein, 372 aa, Corynebacterium glutamicum
MDNGMTITTEHSTHPDLDFNDEIYRELNRICASLSQQCSTYQPEFRTCLDAAFQALRGGKLIRPRMLLGLYNTLVDDDIEVKLNTVLQVAVALELLHFSLLVHDDVIDGDLYRRGKLNFIGQILMHRTPESFAQIQRDPEHLDWAQSNGLLMGNLFLAATHQIFARLDLPHHQRVRLLDLLNHTINDTIVGEFLDVGLSSKAISPNMDIALEMSRLKTATYTFELPMRAAAILAELPQEIETKIGEIGTNLGIAYQLQDDYLSTFGDAAEHGKDAFSDLREGKETTIIAFARDTAKWTDIQDNFGSADLSTSQAERIQHLLIQCGAKNHSLNAISDHLNICRSMIKTLSPQVDPKAQNLLLKQVEQLASRKS

SEQ ID NO: 271 - DNA, 1056 bp, Corynebacterium glutamicum
  CDS (101)..(1033): RXS01879
ctttgcgggccgctgatattgatccaacgcttcgtggcgaaaagcttgatgtcactgactatgtgcgcctagctggggtgttgcagcaaaaggatgagaagtgaaaattaccgctaaggcgtgggcgaaaaccaacctgcatttaggtgtgggaccggctcacgacgatggatttcacgagctcatgacggtgtttcaaaccattgatctgtttgacaccgtcaccttaaccaccctcgatgaggagttggtggaggaggggagcgtcgtcaagcaattatctgtgaccggtgcccgtggcgtgcctgaggacgccagcaatcttgcgtggcgcgctgtggatgcgttggttaagcggcgcgcggaaaagacgccgctgtctgcagtttcgctgcatatttccaaggggattccggtggctggcggcatggctggcggctctgcggatgcggctgcgacactgcgcgcagtggatgcctggattgggcctttcggcgaggacacattgctggaggttgccgcggagctcggctcagatgtgccgttttgcctgcttggtggcaccatgcgcggtaccggtcgcggcgagcagctggtagatatgttgacgcgcggcaagctacattgggtggtggccgcgatggcgcatggcctgtccacgcctgaggtattcaaaaagcatgatgagctgaatccggaatcgcatatggatatcagcgacctcagcgccgcacttctcaccggcaacaccgccgaggtggggcagtggctgcacaatgatctgaccagcgccgcactcagtttgcgccctgaactgcgcagcgtcctccaagaaggcatccgctccggcgcgcatgcaggaattgtctccggctccggcccgaccacggtattcttgtgcgaatcggagcacaaagcgcaagacgttaaagaggcgctaatcgacgccggccaggtgtacgctgcttacaccgccaccggccctgcggcctcaaccgccgaccagcgcggcgcacacattttgactgtttcataataaagacaaacttaagtatc

SEQ ID NO: 272 - protein, 311 aa, Corynebacterium glutamicum
VKITAKAWAKTNLHLGVGPAHDDGFHELMTVFQTIDLFDTVTLTTLDEELVEEGSVVKQLSVTGARGVPEDASNLAWRAVDALVKRRAEKTPLSAVSLHISKGIPVAGGMAGGSADAAATLRAVDAWIGPFGEDTLLEVAAELGSDVPFCLLGGTMRGTGRGEQLVDMLTRGKLHWVVAAMAHGLSTPEVFKKHDELNPESHMDISDLSAALLTGNTAEVGQWLHNDLTSAALSLRPELRSVLQEGIRSGAHAGIVSGSGPTTVFLCESEHKAQDVKEALIDAGQVYAAYTATGPAASTADQRGAHILTVS

SEQ ID NO: 273 - DNA, 891 bp, Corynebacterium glutamicum
  CDS (101)..(868): RXS02023
gatgtggcagcaattttgaagcagtacctgagcgagtaaccgcattcggggttatcgtgggacttccgaaatgtaactagagactagaggaggaaacacgatggctcctaaacaaactcccagcccagagaagaatcgaaacctggtgggaccagttctgcaacgtcggcagacagagggtacttttgatcaacgcttgctagaaatgcgcgctgatcacaattggaagcacgccgatccatggcgtgtactgcgtattcagtctgagtttgtggcgggttttgatgccctccacgagatgccaaaggccgtaaccgtctttggttccgcacgcattaaagaggatcacccgtactacaaggcgggtgtagaacttggtgaaaagctcgttgcagcggactacgcagttgtcaccggtggcggtccaggtctgatggaagcccccaataagggggcaagcgaggccaatggtttatcagttggtctgggcattgagttgccacatgaacagcatctgaacccttatgtggatttgggtctgaacttccggtacttcttcgcacgcaagaccatgttcctgaaatactcccaggcttttgtgtgtctgcctggtggtttcggcacgctcgatgagcttttcgaggtcctctgcatggtacaaaccggcaaggtacccaactttcccatcgtgctgatcggcactgagttctgggcaggtttggtggattggatccgtcaccgcctggtagaggaaggcatgatcgatgagaaggatgttgaccggatgttggtcactgatgacctggatcaggccgtcaaattcatcgtcgatgcacacgctggattggacgtagcgcgtctccacaattaagcagtggctacattaggtgt

SEQ ID NO: 274 - protein, 256 aa, Corynebacterium glutamicum
MAPKQTPSPEKNRNLVGPVLQRRQTEGTFDQRLLEMRADHNWKHADPWRVLRIQSEFVAGFDALHEMPKAVTVFGSARIKEDHPYYKAGVELGEKLVAADYAVVTGGGPGLMEAPNKGASEANGLSVGLGIELPHEQHLNPYVDLGLNFRYFFARKTMFLKYSQAFVCLPGGFGTLDELFEVLCMVQTGKVPNFPIVLIGTEFWAGLVDWIRHRLVEEGMIDEKDVDRMLVTDDLDQAVKFIVDAHAGLDVARLHN

SEQ ID NO: 275 - DNA, 1242 bp, Corynebacterium glutamicum
  CDS (101)..(1219): RXS00948
acaccctccaaatgatctcgtaaaacagtattgaatttaggtacgactctaatcgtaccttgccctcaagccaagctagttgtacgatcaaactcgttgtatggcaaacgtcgtactagtcgatcgaatggagcctttggtgtccaagctgtttaccccaattcaaatccgcgacatcaccatccccaaccgcgtgtggatgtcaccgatgtgcacctactctgcagccaccggttcaggtcttcccaccgattttcaccaggctcattacgcagctcgcgcagcaggtggtgtcggattagtcatggttgaagcaactggagtgaaccccgtagctcccatctccccagtcgaccttggactttggagccatgaccaaattgaaccattctcccgagtgacagcagctattcgcgccggtggggcagtaccggccgttcaattagcccatgctggccgcaaggcatccaccgatgctccgtggaatggtggcggatatgttggaccagaaaccaatggatgggagactgtcggccccagccctctggcattcccaggtttgcctgctccgcgcgagctgacggtttcagaaatccaagaggttgtgcagcagttcgctggcgccgccgttcgtgccgatcaggctggttttgatgtcgtggaaattcacgcagcacacggctaccttttgcataacttcctttctccgatctccaacaagcgcaccgattcatacggcggatctttagaaaaccgcgctcgcatcgtgctcgaagtcattgatgcaatccgcgcagtgtggccagaggaaaagcctgtattcatgcgcatttccaccaccgactgggtggaggaaaacccacaggatgatcgcgagtcctggacgctgagccaaagcaggcagctggctttgtgggcatccgagcacggagttgatttgatcgatgcctcttctggtggcctcgacatcgtccccattccgcatgaccgcgattaccaaaccgcgaaggccgcagatcttcacgcaagtaccggagtgacagtcgctgctgtggggcgcattgatgacgcccaaactgcgcacaatttggttgattctggcgatgtcaatgcagttttcctcggccgtccactgctcaaggatccttcctgggcaaaccaagcagccctcgcactaggtgcggaacccaggtatgttcaccaatacgactacgtactttaaaggagagttgacatgaaggt

SEQ ID NO: 276 - protein, 373 aa, Corynebacterium glutamicum
MANVVLVDRMEPLVSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 277 - DNA, 1026 bp, Corynebacterium glutamicum
  CDS (101)..(1003): RXS02228
acagaagcgtcaactgctcaacttctcgacagcgacgacacacacggcgtgggacgctacgttgctcgctggactttttaacttaagggagatctagatcgtggtaacaccgatcgcagtggttggacccactgcatctggaaaatcagctttgggaattgctctagcccacaagcttgacggtgaagtagtcaatgtggattccatgcagctgtacaaaggcatggacatcggcacggcaaagctgactgtcgaagaacgcgaaggcattgcgcatcatcagctcgatgtctgggacgttaccgaaactgcgtcagtggcgaggtttcaatccgacgccgttgccgatgtggaagatattatgtcccgtggcaaaacccccatcttggttggcggctccatgttgtacgtccaatctttggtcgatgattggcaattcccacctaccgacagcgctgttcgcgcacgctttgaggcccgcttggcagacatcggtgtcgaagcactacacgctgaacttactcagcttgacccagaagcagcagccgtcatcgaaagcaatgatccccgacgcaccgtccgagcattagaagtcattgaactaaccggccagcccttccaagcaagccaaccgcccaaagacgcgccacctcgctggggaactcgaatcattggcctgaaaaccactccagaatggctaaatccacgcatcgagcagcgcaccgccaggatgtttgaacaaggctttgtcgccgaagtggaacaccttgtgcagcaaggactcatcgctgactccaccgcgggacgagcaatcggctactcccaagtactggcagccatggcaggggagatgacctgggaagacgccttcgaacgcacggtcaccggaaccagacgctatgtcaggcgccaacgcagctggttcaacagagaccaccgcgtgtcctgggtcgacgcctctggcgatcccaccgcacaagccttggagattttgggtctacaatagcgagggtgaatttgaccatc

SEQ ID NO: 278 - protein, 301 aa, Corynebacterium glutamicum
VVTPIAVVGPTASGKSALGIALAHKLDGEVVNVDSMQLYKGMDIGTAKLTVEEREGIAHHQLDVWDVTETASVARFQSDAVADVEDIMSRGKTPILVGGSMLYVQSLVDDWQFPPTDSAVRARFEARLADIGVEALHAELTQLDPEAAAVIESNDPRRTVRALEVIELTGQPFQASQPPKDAPPRWGTRIIGLKTTPEWLNPRIEQRTARMFEQGFVAEVEHLVQQGLIADSTAGRAIGYSQVLAAMAGEMTWEDAFERTVTGTRRYVRRQRSWFNRDHRVSWVDASGDPTAQALEILGLQ

SEQ ID NO: 279 - DNA, 954 bp, Corynebacterium glutamicum
  CDS (101)..(931): RXC01971
aggtcttgtttatttcggctactgattcagtagctgcgctccgataggattcttagttttcagttcagtatctttgagccacggctagaatgtgaatcctatgtctaagaagaagcctcgccccattccggttcctgcccaatttatccctggtctcattgatgcgcatacacatttggcatcgtgtggaggagatcttgcagggttggtggaaagggccaaggaggcgggcgtcgaaaagctttgtaccgtcggtgatggtttggctgaggccgagcttgcgctggaggccgcgcaacagtttggcaatgtgtttgctgcgtgtgcgattcatccgacgaaggctgatcagttggatggggctgcgcgtgcgcggctgacgcagatggcggcggatccgaattgtgtggccattggtgagactggtttggattcgtattggatcaagcacgatccagaggacacggcggcgttggatgtgcaagaggaggcgctgcgctggcatattgatttggcaattagtgcggataagccgttgatgattcacaatcgtgaggcggatgctgatttgatgcgagtgttggcggatgctccacctccaaaagatacgattctgcattgtttttcttcgccgttggacgtggcgaaggaagcgttggatcgtggatatgtgttgagttttgcgggcaatgtgacgtttaagcgtaatgaggagttgcgggaggctgctcgtattgcgccgatttcccagattttgattgaaaccgatgcgccgtatatgacgccggagccgtttcgggggagtaggaatgagccgtcgttgattggtcatacggcgctatgcattgcggaggttcgggggatggctgtggaggatgttgcggcggctttgaatgagaattttgatcgcgtttatggggtcacaaatctataacgtgaggtagctcacagtca

SEQ ID NO: 280 - protein, 277 aa, Corynebacterium glutamicum
MSKKKPRPIPVPAQFIPGLIDAHTHLASCGGDLAGLVERAKEAGVEKLCTVGDGLAEAELALEAAQQFGNVFAACAIHPTKADQLDGAARARLTQMAADPNCVAIGETGLDSYWIKHDPEDTAALDVQEEALRWHIDLAISADKPLMIHNREADADLMRVLADAPPPKDTILHCFSSPLDVAKEALDRGYVLSFAGNVTFKRNEELREAARIAPISQILIETDAPYMTPEPFRGSRNEPSLIGHTALCIAEVRGMAVEDVAAALNENFDRVYGVTNL

SEQ ID NO: 281 - DNA, 1650 bp, Corynebacterium glutamicum
  CDS (101)..(1627): RXC02697
tttggctcacctcgatgatgtagacatccccgatgaggtgcgcgcacagttgcgggcactggctatccgctcaaccgaacgtcggatgtagtagacgcgtatgacactttttcaacgtttaaccaaccctgtagtgctcggcggcctagcaggtgttttgcttctgctcggctctttcggtggcggtgccattcggtaccgtggcggagtgctcgatgcgttggggcttaacttccttgcttttggccacgcgcagggtatttccaataccgtgttgtgggttgggcagctgctgctgattggcgcgtgggttcaccttggacgtcggttgttcaagaaaaaagtcgctgatgacaccgcagacgctgctgacttaggtcttgtaaagcgcacgttgtatgccatggtggtgcccctcatttttgcggcaccaatgatgtcgcgtgatgtttattcctatctcatgcagggcgcgatgctgcgtgatggcttcgatccctacactgagggcgctgcggtaaaccctggccccatgttgcttgaggtctctcatgattggcgcaacaccacgacgccgtatggtccactacacctgtggattggagacatgatcaccacggttgtgggcgataatgtcaccttgggcgtcgtcgcttacaagatcttgtcgatcattggccttgctgtgacaggctggagcattgtccgcattgcacaacattttggagccaacccagcaattgcattgtggattggtgtggccaatcctgtgatgatcatccacatgatcggcggcatgcacaatgaatccctcatggtgggattggtcagcgtcggcttgttgctagcactgaagaagcgtttcgtggcaggtgtggcactcattgcagtggctgtgtcgctgaaagctacagcggcgattgcacttccttttgtggtgtggatcggcatgcatcatttcgcaggattcttagccaccaaaaagggcaaagactcccctacccttaagcaacaggtccccgcgttctttgccactggagctgcaggtgttgctgtcactggtgttgttgtcagtgcgatcacttgggcgtctggcgcttcgtggggctggatcagtgagatcagtggcaacagcaaggtaatcaacccgctggctttcccttctttggtggccagtgtgatcaccatggtggctgaagtgttcgttgacgatttcgactacaacgcagtggttaatgttgtgcgctcaatctccatgctgatcatgcttggcgggttggtcgtatgttggtggctgttccgccagaacgaacgcagggcggtcactggtacagcagcggcttatgccgtggcttttgtgttcaattctgtgaccttgccgtggtactacgccagcttgatctctttgctcggcacatttaaaccaccgatgtggttgattcgcttcgcagcgggtgcttcggtgtttatcgcgctgatgtttaccggaagtggaaaccaccagctgtacaacatcgttacggtgatcatcgcagcaattatcgcgtggcttgccaccgtggtgatctttgatgacactgaccctgcaacaacggccacggagaaaccctccccgcataccgtttcctagttgcataaggtaaaccgcca

SEQ ID NO: 282 - protein, 509 aa, Corynebacterium glutamicum
MTLFQRLTNPVVLGGLAGVLLLLGSFGGGAIRYRGGVLDALGLNFLAFGHAQGISNTVLWVGQLLLIGAWVHLGRRLFKKKVADDTADAADLGLVKRTLYAMVVPLIFAAPMMSRDVYSYLMQGAMLRDGFDPYTEGAAVNPGPMLLEVSHDWRNTTTPYGPLHLWIGDMITTVVGDNVTLGVVAYKILSIIGLAVTGWSIVRIAQHFGANPAIALWIGVANPVMIIHMIGGMHNESLMVGLVSVGLLLALKKRFVAGVALIAVAVSLKATAAIALPFVVWIGMHHFAGFLATKKGKDSPTLKQQVPAFFATGAAGVAVTGVVVSAITWASGASWGWISEISGNSKVINPLAFPSLVASVITMVAEVFVDDFDYNAVVNVVRSISMLIMLGGLVVCWWLFRQNERRAVTGTAAAYAVAFVFNSVTLPWYYASLISLLGTFKPPMWLIRFAAGASVFIALMFTGSGNHQLYNIVTVIIAAIIAWLATVVIFDDTDPATTATEKPSPHTVS

SEQ ID NO: 283 - DNA, 1298 bp, Corynebacterium glutamicum
  CDS (1)..(1275): RXN01946
atccgcaagtactccaggctcgaggaacaattccagtcgctcggcggctacgaagctgacgccgaagcagcccagatctgcgacaacctcggcctcgaggcacgcatcctcgaccagcagcttaaaaccctgtccggcggccagcgccgccgcgtcgagttggcgcagatcctcttcgccgccaccaacggctccggcaaatcaaaaaccacattgcttctcgacgagcccaccaaccacttggacgcagactcgatcacctggctccgtgacttcctggcgaagcacgaaggtggactgatcatgatttcgcacgacgtcgaactgcttggcgccgtatgtaacaagatttggtacctcgacgcagtacgcagcgaagccgatgtctacaacatgggctttagcaaatacgtcgatgcacgtgcactcgatgaagcacgccgacgccgtgagcgcgcaaacgccgaaaagaaggccggagccctcaaggaccaggctgcacgcctcggcgcgaaagcaaccaaggctgccgcagctaagcagatgatcgcccgtgcggaacgaatgatcgacaacctcgacgaaatccgcgtagctgaccgcgccgccaacatcgttttcccagaaccagcaccctgtggaaaaaccccactcaacgccaagggcctgaccaagatgtacggctccctcgaagtcttcgccggcgtcgacctagccatcgacaaaggctcccgcgtagtcgtcctcggattcaacggtgcaggtaaaaccaccctgctcaaactcctcgccggtgtggaacgcaccgacggcgaaggcggcatcgtcaccggatacggcctcaaaatcggctacttcgcccaggaacacgacaccatcgaccccgacaaatccgtctggcaaaacaccatcgaagcctgcgccgacgccgaccaacaaagcctccgcagcctcctcggatccttcatgttctccggcgaacaactcgaccaaccagcaggaacactctccggcggtgaaaaaacccgcctcgcactggccaccctcgtgtcctcccgcgcaaacgtcctgcttctcgacgagcccaccaacaaccttgacccgatctcccgcgaacaggtcctcgacgcactgcgcacctacaccggcgcagtcgtcctggttacccacgacccgggtgcagtcaaggcccttgagccagaacgcgtcatcgtgcttcctgatggcaccgaggatctttggaatgatcagtacatggaaatcgtggaattggcgtaggttctaaggctgtttatgct

SEQ ID NO: 284 - protein, 425 aa, Corynebacterium glutamicum
IRKYSRLEEQFQSLGGYEADAEAAQICDNLGLEARILDQQLKTLSGGQRRRVELAQILFAATNGSGKSKTTLLLDEPTNHLDADSITWLRDFLAKHEGGLIMISHDVELLGAVCNKIWYLDAVRSEADVYNMGFSKYVDARALDEARRRRERANAEKKAGALKDQAARLGAKATKAAAAKQMIARAERMIDNLDEIRVADRAANIVFPEPAPCGKTPLNAKGLTKMYGSLEVFAGVDLAIDKGSRVVVLGFNGAGKTTLLKLLAGVERTDGEGGIVTGYGLKIGYFAQEHDTIDPDKSVWQNTIEACADADQQSLRSLLGSFMFSGEQLDQPAGTLSGGEKTRLALATLVSSRANVLLLDEPTNNLDPISREQVLDALRTYTGAVVLVTHDPGAVKALEPERVIVLPDGTEDLWNDQYMEIVELA

SEQ ID NO: 285 - DNA, 1298 bp, Corynebacterium glutamicum; identical to SEQ ID NO: 283
  CDS (1)..(1275): FRXA01946

SEQ ID NO: 286 - protein, 425 aa, Corynebacterium glutamicum; identical to SEQ ID NO: 284

SEQ ID NO: 287 - DNA, 1812 bp, Corynebacterium glutamicum
  CDS (101)..(1789): RXN00164
ctgctttgcgggaggttatgaaatgagtggggagacgtcgaaaagcatgcgctttccgttggccagcctgccgcaagtgcggcgcgaggtggcccggcaggtgggtcgtattccgcgggcgaagtggtggtttttaggcgcgctggtgttgctgagtgcgggcgcttatgcgtcggtgctggtgccgcaggtgctggggcggattgtggatctggtgtccgatggcgcgcagatgcgtgattttgttgagctcagtgtgattctcattgcggtggcaattgccggcgcggtgctcagtgcgtgcgggttctatgtggtgtcgcggatttctgagaagattatcgccaatttgagggaagatatggtgggcaccgcgcttgggttgcccacgcaccaggtggaagatgcgggctctggcgatttggtgagccgctccaccgatgatgtctccgagctatccgcagcggtgacagagaccgtcccgattttaagttcctcactgtttaccattgccgcgacgatcattgcgctgttttctttggactggcaatttgtgctcattcctgtcgtggtggcgccggtgtactacttcgcgtccaagcactatttgagcaaggcgccggatcggtatgcggcagaacgcgcggcgatggcggagcgtgcgcgaaaggtacttgaggctattcgcgggcgtgcaactgtgcgggcgtattccatggaagatgccatgcataatcagattgatcaggcgtcgtggtctgtggtggtcaagggtattcgtgcgcgcaccaccatgttgattttgaacatgtggatgctgtttgcggaattcctcatgctcgcggtcgcgttggtgatcggctacaagctggtcattgataatgcgctgacgatcggcgcggttaccggtgccgtgctgatgattattcgtctgcgtggcccgatgaatatgttcatgcgcgtgctcgacaccattcaatccggctatgcgtcgctggcgcgcatcgtgggagttgttgcggatccgccgattcctgtgcccgacagcggtgtgaaagcacctcagggcaaagtggaattgcgcaacgtcagctttagctatggcgattcctgggcggtgaaagacatcgacatcacgatcaattccggcgaaactgtcgcgctcgtgggcgcatctggcgcaggtaagacgacggtcgccgccttgctggcgggcttgcgggtgccagatcaagggcaagtgcttgtcgacgacttccccgtctctcacctctctgaccgcgagcgtatcgcccgcttggccatggtcagccaggaggttcatgttttctccggcacgctgcgccaggatctcaccttggctaaaccagatgcctccgatgaggaattagcgcatgctcttgggcaagttaatgcccttgactggttggagagtcttccagaaggactggacacggtcgttggtgcgcgaggaatccagctagaaccagtggtggctcagcagttggcgttggcccgggtgttgttgctcaatccggcgatcgtcatcatggatgaagccacggcagaagcaggatcggcgggtgccagcgcactggaagaggctgcagatgcagtgagcaagaaccgttccgcattggtggtggcgcaccggttggatcaggcatcgcgggctgatcagattctggtgatggataagggggaggttgtggaatccggtactcaccaggagttattggatcacgggggtatttatcagcgtctgtggactgcgtggagtgtcggaagatagttgactgttcaatgcgttga

SEQ ID NO: 288 - protein, 563 aa, Corynebacterium glutamicum
VGRIPRAKWWFLGALVLLSAGAYASVLVPQVLGRIVDLVSDGAQMRDFVELSVILIAVAIAGAVLSACGFYVVSRISEKIIANLREDMVGTALGLPTHQVEDAGSGDLVSRSTDDVSELSAAVTETVPILSSSLFTIAATIIALFSLDWQFVLIPVVVAPVYYFASKHYLSKAPDRYAAERAAMAERARKVLEAIRGRATVRAYSMEDAMHNQIDQASWSVVVKGIRARTTMLILNMWMLFAEFLMLAVALVIGYKLVIDNALTIGAVTGAVLMIIRLRGPMNMFMRVLDTIQSGYASLARIVGVVADPPIPVPDSGVKAPQGKVELRNVSFSYGDSWAVKDIDITINSGETVALVGASGAGKTTVAALLAGLRVPDQGQVLVDDFPVSHLSDRERIARLAMVSQEVHVFSGTLRQDLTLAKPDASDEELAHALGQVNALDWLESLPEGLDTVVGARGIQLEPVVAQQLALARVLLLNPAIVIMDEATAEAGSAGASALEEAADAVSKNRSALVVAHRLDQASRADQILVMDKGEVVESGTHQELLDHGGIYQRLWTAWSVGR

SEQ ID NO: 289 - DNA, 1812 bp, Corynebacterium glutamicum; identical to SEQ ID NO: 287
  CDS (101)..(1789): FRXA00164

SEQ ID NO: 290 - protein, 563 aa, Corynebacterium glutamicum; identical to SEQ ID NO: 288

SEQ ID NO: 291 - DNA, 1140 bp, Corynebacterium glutamicum
  CDS (101)..(1117): RXN00243
cactgcgccagatttttgatgccgacactgtggcaggtgtgcgcgctgagtacgaaaaatttaacaaagcagcccatgatggaaatgaagaggaacagaagtgaccagcgaacaagctttagatcctatccacccaggtcagttccgtctttctcggattcagttgatcaactggggaaccttccacggaacggtggacattcctgtgaccagggaaggaatcttagttaccggtggttcgggatcaggaaaatccacgctgattgatgcgatcacggcggtattgcttccgcaaggaaagctgaggtttaactctgccgcacaggctaatactccgcggaataagggacgcagtttggttacctatatccgtggcgcttggcgtgcgcaggaggatccgctgcaggatcagattgtctccacgtacctacgtccccgcgcaacctattcgctggttggattgacttattccaacggtgaaggcgtcgagcacaccttggtggctattttctatctgaaatcgggacacaatttaacctccgatatttcttcatattatggtgtgtttcccgttgatcaagacatcaatgcgctgctggatttcctgaaagagggcatcgataaacgccagatcagagctgctttcaaggaagccatctttagcgagcagcattctgtattctccggcaggtttagaagccgtttggggatctccagtgaggaagctttgctgttgttgcaccgcgcgcagtcggcgaaagatcttcaaagcttggatgatctatttcgggattacatgctggtggaaccggatacgttcagcattgccaaaactgccgtggaacaattccaagaccttgaaggtgcttatgagcaggtcgaagatattaaacggcagatccacaccctggatcctttggtgcagctgaagaatcggcgagagaaagcgcaacagtccaaagatcatgccaatgcactgaagaaggcgctgccgactgtcgggaatcgcattaagaaggaagagcaagaaccgctggttcgacaatttactgtcgagcaaacgcagcgaagtcgaaggtggagtccgccaaaattgagacagatcgtgcccgcgaaatgaaaaccctcgcgcacgacaac

SEQ ID NO: 292 - protein, 339 aa, Corynebacterium glutamicum
VTSEQALDPIHPGQFRLSRIQLINWGTFHGTVDIPVTREGILVTGGSGSGKSTLIDAITAVLLPQGKLRFNSAAQANTPRNKGRSLVTYIRGAWRAQEDPLQDQIVSTYLRPRATYSLVGLTYSNGEGVEHTLVAIFYLKSGHNLTSDISSYYGVFPVDQDINALLDFLKEGIDKRQIRAAFKEAIFSEQHSVFSGRFRSRLGISSEEALLLLHRAQSAKDLQSLDDLFRDYMLVEPDTFSIAKTAVEQFQDLEGAYEQVEDIKRQIHTLDPLVQLKNRREKAQQSKDHANALKKALPTVGNRIKKEEQEPLVRQFTVEQTQRSRRWSPPKLRQIVPAK

SEQ ID NO: 293 - DNA, 1027 bp, Corynebacterium glutamicum
  CDS (101)..(1027): FRXA00243
cactgcgccagatttttgatgccgacactgtggcaggtgtgcgcgctgagtacgaaaaatttaacaaagcagcccatgatggaaatgaagaggaacagaagtgaccagcgaacaagctttagatcctatccacccaggtcagttccgtctttctcggattcagttgatcaactggggaaccttccacggaacggtggacattcctgtgaccagggaaggaatcttagttaccggtggttcgggatcaggaaaatccacgctgattgatgcgatcacggcggtattgcttccgcaaggaaagctgaggtttaactctgccgcacaggctaatactccgcggaataagggacgcagtttggttacctatatccgtggcgcttggcgtgcgcaggaggatccgctgcaggatcagattgtctccacgtacctacgtccccgcgcaacctattcgctggttggattgacttattccaacggtgaaggcgtcgagcacaccttggtggctattttctatctgaaatcgggacacaatttaacctccgatatttcttcatattatggtgtgtttcccgttgatcaagacatcaatgcgctgctggatttcctgaaagagggcatcgataaacgccagatcagagctgctttcaaggaagccatctttagcgagcagcattctgtattctccggcaggtttagaagccgtttggggatctccagtgaggaagctttgctgttgttgcaccgcgcgcagtcggcgaaagatcttcaaagcttggatgatctatttcgggattacatgctggtggaaccggatacgttcagcattgccaaaactgccgtggaacaattccaagaccttgaaggtgcttatgagcaggtcgaagatattaaacggcagatccacaccctggatcctttggtgcagctgaagaatcggcgagagaaagcgcaacagtccaaagatcatgccaatgcactgaagaaggcgctgccgactgtcgggaatcgcattaagaaggaagagcaa

SEQ ID NO: 294 - protein, 309 aa, Corynebacterium glutamicum
VTSEQALDPIHPGQFRLSRIQLINWGTFHGTVDIPVTREGILVTGGSGSGKSTLIDAITAVLLPQGKLRFNSAAQANTPRNKGRSLVTYIRGAWRAQEDPLQDQIVSTYLRPRATYSLVGLTYSNGEGVEHTLVAIFYLKSGHNLTSDISSYYGVFPVDQDINALLDFLKEGIDKRQIRAAFKEAIFSEQHSVFSGRFRSRLGISSEEALLLLHRAQSAKDLQSLDDLFRDYMLVEPDTFSIAKTAVEQFQDLEGAYEQVEDIKRQIHTLDPLVQLKNRREKAQQSKDHANALKKALPTVGNRIKKEEQ

SEQ ID NO: 295 - DNA, 2325 bp, Corynebacterium glutamicum
  CDS (101)..(2302): RXA00259
ggccttattaacatacggcggttctagcacacagcgatggatgatgtgtcccaccgatattgctgcatgtgccaagatttagcacggtacagtgctagaaatgagcggactgtttaccccattttcagatgcggcaaaaaacaacacggtaaaaactgatggagattcagtatctggtcgagacttgcctattactaagatctctgaggatcgtttcgagcgttctgcgtattcagcccagctggcaaatataatctgcgatgtggcaccttggggagcgagcactgttttcagtcttactggtcagtggggcagtggtaagacatctcttgttaatttgattcgctcggaagaatctctatcgaacgaaaaatggacaatcgttgatttcaacccgtgggtggcctctgacccgcaatctttgattgaggagttttaccgagtaatcgttgggacggtacctgatgataagaccggccaaaagatcaaaactgttctgcagaaaacctttagcacgattgggtcaattgcaggtggggtcggagggtttggtgtcctagaagcacttgcgctctcaaaaggagtagatgctgcaaacgctgtatataagacatggaaacaggagcaagattcgtggccaacgctgtatacacgtgctgcgaaccattttaaagatctgaacaagcgaattctcattgtcgtcgatgatattgatcgcctccatactgatgaattggcgctgttaatgaaagtaatacgcttgcttggacgattcccgcaggtgaattatcttttggtttatgaagaagaatcactgttaacgacgctagccagatcgacagctgtaggtggtagcgaagatgatgctttgcgtttcatggagaaaatcgtgcagtatcctttcgatgttccgcctctgacatcatttcaaatagagaaagagctcagtgcattatttgacaagcttttccagggtgtttcgctatcgggtgatcctgaagactttgcactagtgaagtcgagaatgttcgatgtctgggaaaagactctggtcacgccgaggctgttgcaccgttttgctgctctactaaccaactggactcggatatatggatcaggtgaagttaacggcgttgatctcacaatacttgcgaccattcgaattgtttttccgtctgtgtataaacgtctttctcgagcgaaggaagtattgcttcaaggaggtcgaacgacaggctcgcagaaacccggttgggaaaagcaattatgtgaggggatgaacaacgagcagatggatcttttaaagaccatgcttttgttccttttcccacgtctttcggatcaccctagtacgagaatgcatcgtgagagggggatctcgacggaagtttattttgacacgtacctcatgtttcaaagacctggacatgtcataagtgatgaacagttggataagtatctatctaatgcggacgatgctatgggtttcgtcgatttaattaactccgatgacaatgacatggtggcatcagtgatgaaaaagcttcctctagcaattgatcgacttgatggagagggtgttaggcacatggcagttgaggtgttattcaccgctgctaatggtatgcatgataaaggtcgtcaagtgcgtatgagcggcatattcagtgacctgtattcccatgcgtgctcgattcttggtgcattgcctcaattaccagtggaacaactctatgagaaattcttttctgagatgacgcttaatgaggctgctttctggttaaaccaggtgggggaaagggctagagcctgtggtaatgatgtaagtggccttgagctttttcgtaaagttaatataaagaccgaagctagaattttaagtgtattgaagaatcaggacccctcagattgggatttaggtccatattcgcttggtattttggcgaaaagctcgaatttttcttcagtgctgaagtctctgcaaagtggtatagaggaacatcagtttgatgtgatagatattggagtgcttttcttaacgactgtgtattcttcgcgacagggaccaagcggtggtgcatggatagattcttttcagcatagtctgttttcacggtacgtacctgattctctacgggctataaccaagtctgaagtagatgtagaactaggtaagatacagttcacggattttagctgggaagggaagcgaaaagttgtcgcatatgcactggagactggaagaagtgatttcactcgagaacgattagggggctacagtatcgcagattctatagtcgattgatgaggctgaggtcatgactt

SEQ ID NO: 296 - protein, 734 aa, Corynebacterium glutamicum
MSGLFTPFSDAAKNNTVKTDGDSVSGRDLPITKISEDRFERSAYSAQLANIICDVAPWGASTVFSLTGQWGSGKTSLVNLIRSEESLSNEKWTIVDFNPWVASDPQSLIEEFYRVIVGTVPDDKTGQKIKTVLQKTFSTIGSIAGGVGGFGVLEALALSKGVDAANAVYKTWKQEQDSWPTLYTRAANHFKDLNKRILIVVDDIDRLHTDELALLMKVIRLLGRFPQVNYLLVYEEESLLTTLARSTAVGGSEDDALRFMEKIVQYPFDVPPLTSFQIEKELSALFDKLFQGVSLSGDPEDFALVKSRMFDVWEKTLVTPRLLHRFAALLTNWTRIYGSGEVNGVDLTILATIRIVFPSVYKRLSRAKEVLLQGGRTTGSQKPGWEKQLCEGMNNEQMDLLKTMLLFLFPRLSDHPSTRMHRERGISTEVYFDTYLMFQRPGHVISDEQLDKYLSNADDAMGFVDLINSDDNDMVASVMKKLPLAIDRLDGEGVRHMAVEVLFTAANGMHDKGRQVRMSGIFSDLYSHACSILGALPQLPVEQLYEKFFSEMTLNEAAFWLNQVGERARACGNDVSGLELFRKVNIKTEARILSVLKNQDPSDWDLGPYSLGILAKSSNFSSVLKSLQSGIEEHQFDVIDIGVLFLTTVYSSRQGPSGGAWIDSFQHSLFSRYVPDSLRAITKSEVDVELGKIQFTDFSWEGKRKVVAYALETGRSDFTRERLGGYSIADSIVD

SEQ ID NO: 297 - DNA, 789 bp, Corynebacterium glutamicum
  CDS (101)..(766): RXN00410
gtgttgatgcgttagtccacccacgcagctacgccccaaaggaataatcttgaaccctgccacagataacgctccgccggtcctttcagcccaagatctcatgatgatctatggaaaaggatcaacagaagttcgggctctcgatggcatttctgtacagattcagtccgacaaatggacctccatcatggggcaatcaggctctggcaaaacaactctgttgcagtgcctttccggattggcgcagccaacctcaggcagagtgacactgaacaaaaacaacatcacgttgagctccctgtcagaaaataagcgtgccaagctgcgtcgcacgcacatcagcatggtgtttcaggatttcaacttggtgcctattttgtcggtgaaggacaatattttgctgccgttgcgtcttgcgcatcgcagggtggataagcagtggtttgaacacatcaccagtgtgttgaagattgataatcgtatgcgccatttgcctggggagctgtctggcggtcagcaacaacgcgccgcgattgcccgggcgttgatgtctaggcccgatattgtcattgcggatgagccaacaggaagtttggattccgtcaccagcgatgcagtgttgaatttgttccgcagcattgttgatgattttgggcagtcacttgtgtttgtcacccacgataaagatgctgctcaccgtggtgacgtgttgatcacaatgcgtgatggcaagatcatcgatacggcagatttgcgggtggggcgttaatgttcaggcttgctttcgct

SEQ ID NO: 298 - protein, 222 aa, Corynebacterium glutamicum
MMIYGKGSTEVRALDGISVQIQSDKWTSIMGQSGSGKTTLLQCLSGLAQPTSGRVTLNKNNITLSSLSENKRAKLRRTHISMVFQDFNLVPILSVKDNILLPLRLAHRRVDKQWFEHITSVLKIDNRMRHLPGELSGGQQQRAAIARALMSRPDIVIADEPTGSLDSVTSDAVLNLFRSIVDDFGQSLVFVTHDKDAAHRGDVLITMRDGKIIDTADLRVGR

SEQ ID NO: 299 - DNA, 789 bp, Corynebacterium glutamicum; identical to SEQ ID NO: 297
  CDS (101)..(766): FRXA00410

SEQ ID NO: 300 - protein, 222 aa, Corynebacterium glutamicum; identical to SEQ ID NO: 298

SEQ ID NO: 301 - DNA, 1500 bp, Corynebacterium glutamicum
  CDS (101)..(1477): RXN00456
ctcaccaacccggagatcgtcacagcggtgctaacggatcatgcctagcttatggcgtgctcgtcgcagacttttgctcattgccctaggtgtacttggtgtgctgcaggcactgctggcgatcatggtgtcgttgagcgtagccgccatacttgagggaaaccgagcacttgttggattgctgcttgctaccacgttgggtttgggggtggcgcagtggattcaaaaagtagtggcagaagatctaggccagcattatgtgcatgaggtgcgtcgtgaattggtgggtgctgcgctggtgcctggaaatacggcctcgttgggcgtgactgtcacccgagccagcaatgatctcaccgcggtgcgcaattgggtggctttgggcattgttccgatggtcaccgggctgccgttgattgcgattgtgctggtggcgttgtttatccaagatctccgcacaggcgtggctgttactgtgccactgctcatgtgtgtagccgtgctgccggtggtggcgcggtggactttgaaaagagcacgtgaactacgcaaaaaacgtggacgcatggctgcgcggatcgcagattctgtcatggctggagaattactgcacgcaacaggagcaatagaccgtgagctcaatgcagtcacccgagattccgaccgagtggtgatagctgctgtaagacgttcctgggccaccggttttagccgcgcattgatggccatggcagcctcgcttggcactgtcagcattgtgatttctggccacctggaagtaagtgaggttgcgggaataatgatgcttcttggcgttcttgccactccagttgcagaacttggccgcgtggtggaatatcgccaaaattataaagccgcgacacgcatcctgattccacttctgcaacgaggctcagaatttaaacactcccaacaaaaactacccgggttgcaagcaacagaaggaatccccggtgtctatgtcaaaggtatttccgcccttcctggagaacggatctacctccacggctctgcagatgcgacgagaaaatgggtcacctcgttgtctgcaatggaggaaggcacagatgtaatagtcaacggtcaaaggctttcgcagcttcctttgaaacaacgacgcgccctcatcggaatcgcctcagcacaccaccacttaagccgtggttcagtatcgcgcctggttggtttgcgagtgccggatgccaccgtggaagaaattgagcaagcactggaacaagttggtctgaacaacaccgggaaacaacgcttgaaaaacggcggacacccctggagtacttcgcagatcaacaaactgaaaattgccagcgccacccttcgaaccccaccgcttttggtacttgaaggcatcacccctgaaaacctcctcaactatcccggagtgatcatctccaccgttcaggagaacccatccgaaacatggcggcaagtgaacatctaatctagaaacatggcaggacg

SEQ ID NO: 302 - protein, 459 aa, Corynebacterium glutamicum
VLQALLAIMVSLSVAAILEGNRALVGLLLATTLGLGVAQWIQKVVAEDLGQHYVHEVRRELVGAALVPGNTASLGVTVTRASNDLTAVRNWVALGIVPMVTGLPLIAIVLVALFIQDLRTGVAVTVPLLMCVAVLPVVARWTLKRARELRKKRGRMAARIADSVMAGELLHATGAIDRELNAVTRDSDRVVIAAVRRSWATGFSRALMAMAASLGTVSIVISGHLEVSEVAGIMMLLGVLATPVAELGRVVEYRQNYKAATRILIPLLQRGSEFKHSQQKLPGLQATEGIPGVYVKGISALPGERIYLHGSADATRKWVTSLSAMEEGTDVIVNGQRLSQLPLKQRRALIGIASAHHHLSRGSVSRLVGLRVPDATVEEIEQALEQVGLNNTGKQRLKNGGHPWSTSQINKLKIASATLRTPPLLVLEGITPENLLNYPGVIISTVQENPSETWRQVNI

SEQ ID NO: 303 - DNA, 412 bp, Corynebacterium glutamicum
  CDS (101)..(412): FRXA00456
ctcaccaacccggagatcgtcacagcggtgctaacggatcatgcctagcttatggcgtgctcgtcgcagacttttgctcattgccctaggtgtacttggtgtgctgcaggcactgctggcgatcatggtgtcgttgagcgtagccgccatacttgagggaaaccgagcacttgttggattgctgcttgctaccacgttgggtttgggggtggcgcagtggattcaaaaagtagtggcagaagatctaggccagcattatgtgcatgaggtgcgtcgtgaattggtgggtgctgcgctggtgcctggaaatacggcctcgttgggcgtgactgtcacccgagccagcaatgatctcaccgcggtgcgcaattgggtggctttgggcattgttccgatggtcaccgggctgccg

SEQ ID NO: 304 - protein, 104 aa, Corynebacterium glutamicum
VLQALLAIMVSLSVAAILEGNRALVGLLLATTLGLGVAQWIQKVVAEDLGQHYVHEVRRELVGAALVPGNTASLGVTVTRASNDLTAVRNWVALGIVPMVTGLP

SEQ ID NO: 305 - DNA, 1040 bp, Corynebacterium glutamicum
  CDS (31)..(1017): FRXA00459
aggcgtggctgttactgtgccactgctcatgtgtgtacccgtgctgccggtggtggcgcggtgactttgaaaagagcacgtgaactacgcaaaaaacgtggacgcatggctgcgcggatcgcagattctgtcatggctggagaattactgcacgcaacaggagcaatagaccgtgagctcaatgcagtcacccgagattccgaccgagtggtgatagctgctgtaagacgttcctgggccaccggttttagccgcgcattgatggccatggcagcctcgcttggcactgtcagcattgtgatttctggccacctggaagtaagtgaggttgcgggaataatgatgcttcttggcgttcttgccactccagttgcagaacttggccgcgtggtggaatatcgccaaaattataaagccgcgacacgcatcctgattccacttctgcaacgaggctcagaatttaaacactcccaacaaaaactacccgggttgcaagcaacagaaggaatccccggtgtctatgtcaaaggtatttccgcccttcctggagaacggatctacctccacggctctgcagatgcgacgagaaaatgggtcacctcgttgtctgcaatggaggaaggcacagatgtaatagtcaacggtcaaaggctttcgcagcttcctttgaaacaacgacgcgccctcatcggaatcgcctcagcacaccaccacttaagccgtggttcagtatcgcgcctggttggtttgcgagtgccggatgccaccgtggaagaaattgagcaagcactggaacaagttggtctgaacaacaccgggaaacaacgcttgaaaaacggcggacacccctggagtacttcgcagatcaacaaactgaaaattgccagcgccacccttcgaaccccaccgcttttggtacttgaaggcatcacccctgaaaacctcctcaactatcccggagtgatcatctccaccgttcaggagaacccatccgaaacatggcggcaagtgaacatctaatctagaaacatggcaggacg

SEQ ID NO: 306 - protein, 329 aa, Corynebacterium glutamicum
VCTRAAGGGAVTLKRARELRKKRGRMAARIADSVMAGELLHATGAIDRELNAVTRDSDRVVIAAVRRSWATGFSRALMAMAASLGTVSIVISGHLEVSEVAGIMMLLGVLATPVAELGRVVEYRQNYKAATRILIPLLQRGSEFKHSQQKLPGLQATEGIPGVYVKGISALPGERIYLHGSADATRKWVTSLSAMEEGTDVIVNGQRLSQLPLKQRRALIGIASAHHHLSRGSVSRLVGLRVPDATVEEIEQALEQVGLNNTGKQRLKNGGHPWSTSQINKLKIASATLRTPPLLVLEGITPENLLNYPGVIISTVQENPSETWRQVNI

SEQ ID NO: 307 - DNA, 771 bp, Corynebacterium glutamicum
  CDS (101)..(748): RXN01604
ctctcatgttgttgtcctctagttgacagcgggggtggtggtggtcctaaaatagcctacgataactgatagtgtttcctccacttacggaagaagatacatgaatacccctcttttgagaagctctgggctctccatccgcgacacacccttcgccgatgttgagatagctccagacagcggactcactttgctgagcaccgggcgcgaatcccaatccagttccttttctttggtactttccggccgcatgcgcgcctccaccggaaccatcgaattaaacggcgaacccatcaaggcaaccaagctggccaagcatgtggctttggcgggcatccctgaaatcgattcactcgagcgacttgtcactgtgcgcaccgttgtccgtgaacaactcgcctggtcaagcccttggtacctgatggtgcccagggatattagtgattcgggacggtgggttgacgtcgaaaagcatcttggcctgaacctgaaccctaaaaccttaatcggcgacctcagcgtgctcgagcgttttaagctgcgcatcgcgctggcgctgctggcgcggccagaggcgcaactgttggtcgtggatgatcccgatcaagtgcgcagcatggaattgcgtgcggaggtgttgcacgcattgaaaggcgttgcagaggatctccctgtggtcgtggtatccaccaacccagattttgattccttggccgataccgctttgaccattacgggggctggaaactaatggcatttttacactttggc

SEQ ID NO: 308 - protein, 216 aa, Corynebacterium glutamicum
MNTPLLRSSGLSIRDTPFADVEIAPDSGLTLLSTGRESQSSSFSLVLSGRMRASTGTIELNGEPIKATKLAKHVALAGIPEIDSLERLVTVRTVVREQLAWSSPWYLMVPRDISDSGRWVDVEKHLGLNLNPKTLIGDLSVLERFKLRIALALLARPEAQLLVVDDPDQVRSMELRAEVLHALKGVAEDLPVVVVSTNPDFDSLADTALTITGAGN

SEQ ID NO: 309 - DNA, 629 bp, Corynebacterium glutamicum
  CDS (1)..(606): FRXA01604
gacacacccttcgccgatgttgagatagctccagacagcggactcactttgctgagcaccgggcgcgaatcccaatccagttccttttctttggtactttccggccgcatgcgcgcctccaccggaaccatcgaattaaacggcgaacccatcaaggcaaccaagctggccaagcatgtggctttggcgggcatccctgaaatcgattcactcgagcgacttgtcactgtgcgcaccgttgtccgtgaacaactcgcctggtcaagcccttggtacctgatggtgcccagggatattagtgattcgggacggtgggttgacgtcgaaaagcatcttggcctgaacctgaaccctaaaaccttaatcggcgacctcagcgtgctcgagcgttttaagctgcgcatcgcgctggcgctgctggcgcggccagaggcgcaactgttggtcgtggatgatcccgatcaagtgcgcagcatggaattgcgtgcggaggtgttgcacgcattgaaaggcgttgcagaggatctccctgtggtcgtggtatccaccaacccagattttgattccttggccgataccgctttgaccattacgggggctggaaactaatggcatttttacactttggc

SEQ ID NO: 310 - protein, 202 aa, Corynebacterium glutamicum
DTPFADVEIAPDSGLTLLSTGRESQSSSFSLVLSGRMRASTGTIELNGEPIKATKLAKHVALAGIPEIDSLERLVTVRTVVREQLAWSSPWYLMVPRDISDSGRWVDVEKHLGLNLNPKTLIGDLSVLERFKLRIALALLARPEAQLLVVDDPDQVRSMELRAEVLHALKGVAEDLPVVVVSTNPDFDSLADTALTITGAGN

SEQ ID NO: 311 - DNA, 2262 bp, Corynebacterium glutamicum
  CDS (101)..(2239): RXN02547
ggggccgtcgataagcgaagaacaattagcactgcgcgcgctggtctgacgcattggttaaggggctggcggtccggcgccggaatcggcggaggagcttttggagctcaacaacgctgcgcggctgaccgtggatgagtatccggcggcgagggaagcgcttgaatctgcaggtcagaggaatgtagaggaccgaacccgtgcggttgatgagttcaaagcggcggatcaagagctgtcttctttgagtaaaggcagcagtaatattgagtaccgtttgctgcaggtgcgggaaaatttgtgtcaggatttgggcgtgagcccgcgggatatgccctttgccggtgagctgattgatccgaataatgcggaatgggaacccgttgtgcagcgcattttgggtggttttgctgcggaaatgttggttcctcatgggttgttgccacgggttcgggattgggtaaatgccaaacatttggcagcgctgctgaaattcaacggcgtggtgacaacgggggagtacaaaacctcgcgttttccggcggattccctgatccgaaaagttgatgttgtggagtcgccgtttcgcgattgggtaaatcaagaattaggcaagcgttttaatattcggtgcgtgcgcactcctgaggaattgtcggcgctggggccacgcgatcagggcgtgaccattttgggtgtgcgaaaatttgcgcagcagacaggcgatccgacgacgcgttgggaaaaagatgatcgccgaaagctgggggatcgttccacataccgtttgggttccaccaatgatgccaaggtggaaacgcttcgggaaaccgtgaaagctggcaaagcagttgtgcaggcagctgataatcgcattgctgcaaaccgcgctgagctgcgggaacttgaacggcagtatcaagcttcgcaagaaattttgaaagtgtcgtgggctcagattgatgtggaatcagccgacgcggcgattgctgagctggaccgattgctggaagagctgaacaacactccagaggccaccgagctttccgcgcggcatgaggcggcgaagcagacgctcgcgagggtttctgacttgcttgtcgcagctcagagtgaggaaaccgtggcgtcgatgaacctgaaacgcgccgaaactgaattgaaacggctcgaaagcctgccggttgcggaggtttctgaagaaatcgcgcgggaagtggagaaactatttcttgccaacacccgccgggttcacgccgccaacgtggatgagcagaccattgcgctgcgcgaggatctggacaaacaaatcgatgccaatgaggcagaacttcgacgttgtgaaaaccaaattgttggcattttgcgcagctatattgaaacgtggcctgcgaaccgcgctgacttacaagccgaacctgagtttgttggtgaggccatcaaccgcctcggcgagcttcgcagcgatcgtttggcagaattcacggccaaattcctagggctcatgaacgagatgtccacccgaaacctcggccaaatctcgcggcgtctacgtgatgcgcgccgggaaatcgaggagcgcatcgagccgatcaacgcctccttggcgcagtcggaattcaacgaaggtcgcttcctgcacatcgacatccgtgatcaaagtggtccgattgtgagggaattccagcagaaacttgatgccgctaccagcggtgacctgggaaccagtaccgagaaacaagccttcgcccgttatgcgctgatcgctgaaatcatttccaaactcgcctcccacgactccgccgacgcccgctggcgcaacaccgttctagacacccgccgccacgttcgcttcatcggcctcgagcgcgattccgacggcgcaaccgtcaacacctacgtcgactccgcatcactttcaggcggacaagcccagaagctggtgtttttctgcctcgccgctgccttgcgctaccagctagccgaacccggcgcccattatcccacctacgccaccgtcattctggacgaagccttcgaccgcgccgaccccgccttcacccgccaaaccatgaacgtcttccacagcttcggcttccacatggtgctcgcgaccccgctgaaacttatccaaaccctcggcgattatgtcggctccaccatcgtggtcagctacaccgaaaaaccaaacgcccagggcgcaattcagggcaattccagtttctctaggatcgagaaataacatgccattgtttatcgacg

SEQ ID NO: 312 - protein, 713 aa, Corynebacterium glutamicum
LELNNAARLTVDEYPAAREALESAGQRNVEDRTRAVDEFKAADQELSSLSKGSSNIEYRLLQVRENLCQDLGVSPRDMPFAGELIDPNNAEWEPVVQRILGGFAAEMLVPHGLLPRVRDWVNAKHLAALLKFNGVVTTGEYKTSRFPADSLIRKVDVVESPFRDWVNQELGKRFNIRCVRTPEELSALGPRDQGVTILGVRKFAQQTGDPTTRWEKDDRRKLGDRSTYRLGSTNDAKVETLRETVKAGKAVVQAADNRIAANRAELRELERQYQASQEILKVSWAQIDVESADAAIAELDRLLEELNNTPEATELSARHEAAKQTLARVSDLLVAAQSEETVASMNLKRAETELKRLESLPVAEVSEEIAREVEKLFLANTRRVHAANVDEQTIALREDLDKQIDANEAELRRCENQIVGILRSYIETWPANRADLQAEPEFVGEAINRLGELRSDRLAEFTAKFLGLMNEMSTRNLGQISRRLRDARREIEERIEPINASLAQSEFNEGRFLHIDIRDQSGPIVREFQQKLDAATSGDLGTSTEKQAFARYALIAEIISKLASHDSADARWRNTVLDTRRHVRFIGLERDSDGATVNTYVDSASLSGGQAQKLVFFCLAAALRYQLAEPGAHYPTYATVILDEAFDRADPAFTRQTMNVFHSFGFHMVLATPLKLIQTLGDYVGSTIVVSYTEKPNAQGAIQGNSSFSRIEK

SEQ ID NO: 313 - DNA, 2147 bp, Corynebacterium glutamicum
  CDS (1)..(2124): FRXA02547
gctgcgcggctgaccgtggatgagtatccggcggcgagggaagcgcttgaatctgcaggtcagaggaatgtagaggaccgaacccgtgcggttgatgagttcaaagcggcggatcaagagctgtcttctttgagtaaaggcagcagtaatattgagtaccgtttgctgcaggtgcgggaaaatttgtgtcaggatttgggcgtgagcccgcgggatatgccctttgccggtgagctgattgatccgaataatgcggaatgggaacccgttgtgcagcgcattttgggtggttttgctgcggaaatgttggttcctcatgggttgttgccacgggttcgggattgggtaaatgccaaacatttggcagcgctgctgaaattcaacggcgtggtgacaacgggggagtacaaaacctcgcgttttccggcggattccctgatccgaaaagttgatgttgtggagtcgccgtttcgcgattgggtaaatcaagaattaggcaagcgttttaatattcggtgcgtgcgcactcctgaggaattgtcggcgctggggccacgcgatcagggcgtgaccattttgggtgtgcgaaaatttgcgcagcagacaggcgatccgacgacgcgttgggaaaaagatgatcgccgaaagctgggggatcgttccacataccgtttgggttccaccaatgatgccaaggtggaaacgcttcgggaaaccgtgaaagctggcaaagcagttgtgcaggcagctgataatcgcattgctgcaaaccgcgctgagctgcgggaacttgaacggcagtatcaagcttcgcaagaaattttgaaagtgtcgtgggctcagattgatgtggaatcagccgacgcggcgattgctgagctggaccgattgctggaagagctgaacaacactccagaggccaccgagctttccgcgcggcatgaggcggcgaagcagacgctcgcgagggtttctgacttgcttgtcgcagctcagagtgaggaaaccgtggcgtcgatgaacctgaaacgcgccgaaactgaattgaaacggctcgaaagcctgccggttgcggaggtttctgaagaaatcgcgcgggaagtggagaaactatttcttgccaacacccgccgggttcacgccgccaacgtggatgagcagaccattgcgctgcgcgaggatctggacaaacaaatcgatgccaatgaggcagaacttcgacgttgtgaaaaccaaattgttggcattttgcgcagctatattgaaacgtggcctgcgaaccgcgctgacttacaagccgaacctgagtttgttggtgaggccatcaaccgcctcggcgagcttcgcagcgatcgtttggcagaattcacggccaaattcctagggctcatgaacgagatgtccacccgaaacctcggccaaatctcgcggcgtctacgtgatgcgcgccgggaaatcgaggagcgcatcgagccgatcaacgcctccttggcgcagtcggaattcaacgaaggtcgcttcctgcacatcgacatccgtgatcaaagtggtccgattgtgagggaattccagcagaaacttgatgccgctaccagcggtgacctgggaaccagtaccgagaaacaagccttcgcccgttatgcgctgatcgctgaaatcatttccaaactcgcctcccacgactccgccgacgcccgctggcgcaacaccgttctagacacccgccgccacgttcgcttcatcggcctcgagcgcgattccgacggcgcaaccgtcaacacctacgtcgactccgcatcactttcaggcggacaagcccagaagctggtgtttttctgcctcgccgctgccttgcgctaccagctagccgaacccggcgcccattatcccacctacgccaccgtcattctggacgaagccttcgaccgcgccgaccccgccttcacccgccaaaccatgaacgtcttccacagcttcggcttccacatggtgctcgcgaccccgctgaaacttatccaaaccctcggcgattatgtcggctccaccatcgtggtcagctacaccgaaaaaccaaacgcccagggcgcaattcagggcaattccagtttctctaggatcgagaaataacatgccattgtttatcgacg

SEQ ID NO: 314 - protein, 708 aa, Corynebacterium glutamicum
AARLTVDEYPAAREALESAGQRNVEDRTRAVDEFKAADQELSSLSKGSSNIEYRLLQVRENLCQDLGVSPRDMPFAGELIDPNNAEWEPVVQRILGGFAAEMLVPHGLLPRVRDWVNAKHLAALLKFNGVVTTGEYKTSRFPADSLIRKVDVVESPFRDWVNQELGKRFNIRCVRTPEELSALGPRDQGVTILGVRKFAQQTGDPTTRWEKDDRRKLGDRSTYRLGSTNDAKVETLRETVKAGKAVVQAADNRIAANRAELRELERQYQASQEILKVSWAQIDVESADAAIAELDRLLEELNNTPEATELSARHEAAKQTLARVSDLLVAAQSEETVASMNLKRAETELKRLESLPVAEVSEEIAREVEKLFLANTRRVHAANVDEQTIALREDLDKQIDANEAELRRCENQIVGILRSYIETWPANRADLQAEPEFVGEAINRLGELRSDRLAEFTAKFLGLMNEMSTRNLGQISRRLRDARREIEERIEPINASLAQSEFNEGRFLHIDIRDQSGPIVREFQQKLDAATSGDLGTSTEKQAFARYALIAEIISKLASHDSADARWRNTVLDTRRHVRFIGLERDSDGATVNTYVDSASLSGGQAQKLVFFCLAAALRYQLAEPGAHYPTYATVILDEAFDRADPAFTRQTMNVFHSFGFHMVLATPLKLIQTLGDYVGSTIVVSYTEKPNAQGAIQGNSSFSRIEK

SEQ ID NO: 315 - DNA, 1152 bp, Corynebacterium glutamicum
  CDS (101)..(1129): RXN02571
tggacaggccggggccgcgtacggtgttggttgaggtggtggaggggcgcgtcgaaaagcattgtcgctggttgttgccgcttttggcagtcgggatggcgtggtggctctaactcaaatcgtcggaccgtccggctccgggctcacgcgggaattggaaaaacgctaccgggaaacgcccggagcggtgatgctgaccgccgacccgcgcgcgcatatcacctacctgcgcgcgacagtcgccgaggagctggcctttgggctggaacaacgcggcatcgtacccgcgcagatgtgggagcgcgtccgaaacatcgggctcggcctcgagaatctgctagaccgcgcacccgcgcaactttccggcgggcaaacacggcggctggcgatcggcaccgtcgccatcttagaggcgccaacgatgcttctcgacgaccccctctccggtcttgatacctcctcgcgagcccaactcatcacaatgttggaatcatatgagggcgatgtcatcgtcgctgcgcacaagcggtggctcgacgcgccgactgtgtacttaggggatttggaggagctgtccctgcctgcgcgggtggaattttccggtccatcgcgaacgttttcagcgattacaggaacccgcggacaacaacgccgacgctggtggcaattcaacgaatcccaaccacagtttcagatcggccccctggatattactgtttctgcaggtcaagtgctgtggttgcagggtcccaatggttcagggaagtccacactcctgcgtggtcttgccaatgaacccggcactgaattgatgctgcaaaaccctagcgatcaagtcattgactccactgttgctaattgggtgccaggcagtaacagtgaagaacatccgctggatttatcgcaacgcgaactccgccttgcccaatgcgacgcagccctgggtaataacccggaagttttgcttgctgatgaacccgacgtcggccttgatgtcggcggtcgaaacgccatccaccagcgctttgcggatttcttagggaatgggggagcgctgatcctgacctgccatgatgaaaccttcgtggcagaggtagctgaatacgcgatagtgaaggaaatggggctctaggtttctttggaccaaaccac

SEQ ID NO: 316 - protein, 343 aa, Corynebacterium glutamicum
VVALTQIVGPSGSGLTRELEKRYRETPGAVMLTADPRAHITYLRATVAEELAFGLEQRGIVPAQMWERVRNIGLGLENLLDRAPAQLSGGQTRRLAIGTVAILEAPTMLLDDPLSGLDTSSRAQLITMLESYEGDVIVAAHKRWLDAPTVYLGDLEELSLPARVEFSGPSRTFSAITGTRGQQRRRWWQFNESQPQFQIGPLDITVSAGQVLWLQGPNGSGKSTLLRGLANEPGTELMLQNPSDQVIDSTVANWVPGSNSEEHPLDLSQRELRLAQCDAALGNNPEVLLADEPDVGLDVGGRNAIHQRFADFLGNGGALILTCHDETFVAEVAEYAIVKEMGL

SEQ ID NO: 317 - DNA, 1152 bp, Corynebacterium glutamicum; identical to SEQ ID NO: 315
  CDS (101)..(1129): FRXA02571

SEQ ID NO: 318 - protein, 343 aa, Corynebacterium glutamicum; identical to SEQ ID NO: 316

SEQ ID NO: 319 - DNA, 1746 bp, Corynebacterium glutamicum
  CDS (101)..(1723): RXN02074
cgggggaaggccgtgtcgcatgctcgggctagccttggatctcaagaagaattcgactggtttaaagtctgggctttaagtgcagaaaggttgtggattgatgcgctccctgcttcgtgatatccctgcggtgggttggctaatcaccgcgacgattgttgtgcgcacgctcgttgttgcgctggtcatcgttgggatcggcttgcttatcgacgtcccctcgcccgctcattcagccatgttgtggtgggttctggcaggtgccacggcagcagctgcgctgctgtgcgcggaagcggtgctcccccaacgtattcgtgcacgagttgaacgatcctggcggcggcagttggctgctaaaaatctggagctgaattccagttcgtcagatgatgcccagttgatcacactggcaactgaagccacctcaaaagcatccacttacacagtgatgtttctggggccttactttgcagtatttttggccccactgacagttattgccgttgtcggcgcggctatttcctggccgattgcggggatactgtgcctcgggttgtgcgtgatacctttcgttatttcttgggcacagcgcatgttgaaaggcgctggcgcgggatacgggcgagcatctgggcagttggcaggcgtgtttttggaatcggtgcgcacactaggcaccacgatgatgctgaatgccgctgggcagcgcaggcagatcatcacacagcgcgcagagaatatgcgctcccaagtgatgtcattgctgtaccgaaatcagttgatgattctggtgaccgacggcgtgtttggagttgccaccacaatggttgctgcggtgtttgccattggaggattcttttcaggctctcttactctcggccaagctgtagcactcgtattgctggccaggctgcttattgatcccatcaaccgcatgggtcgcacgttttacaccggcatggcaggcaaaccctcgctgatcgccattgaaaaagccctcgcgacaacctttactgatcagccaactcaacagggacagcgccacgatggggatctggtggtcaacaacttgaagatcgcccgcgatcacagggacattgtgcacggtatctctttcagcattccccgcggttcccacatcgcggtggtaggtcccagtggcgctggtaaatcctctgtggctctagcgttgtccggacttttagagtttgatggtgcgatttccctcggcggccacaactgtgagatgttagatcttcgcgcctcagtcagtttcgtgccccaatcccccacgctgtttagcggaagcatcaaaagcaatatcgatctggcgcgcacgggtgttgattctgatcacatccacgcagcacttttaggcgaagaactccccgcggacctcaaagtcggtgaaaccggcaaaggtgtctccggcggccaagcagcacgcatttccattgcccgaggtttagtaaagaatgctgccgtgattgttctcgacgaggcgaccgcacaactcgactacaccaacgcccgccaggttcgacatcttgccaaatcccttgagtgcacgttggttgagatcacccaccgcccatcagaagccctcgatgcagacttcatcattgttttagaggatggccaattgaccatgatggatacacccagcaacgtttcccagcacaatgcgtttttccgcaccgctgtgatggaggaagaacaatgatttcccgacttctccaattg

SEQ ID NO: 320 - protein, 541 aa, Corynebacterium glutamicum
MRSLLRDIPAVGWLITATIVVRTLVVALVIVGIGLLIDVPSPAHSAMLWWVLAGATAAAALLCAEAVLPQRIRARVERSWRRQLAAKNLELNSSSSDDAQLITLATEATSKASTYTVMFLGPYFAVFLAPLTVIAVVGAAISWPIAGILCLGLCVIPFVISWAQRMLKGAGAGYGRASGQLAGVFLESVRTLGTTMMLNAAGQRRQIITQRAENMRSQVMSLLYRNQLMILVTDGVFGVATTMVAAVFAIGGFFSGSLTLGQAVALVLLARLLIDPINRMGRTFYTGMAGKPSLIAIEKALATTFTDQPTQQGQRHDGDLVVNNLKIARDHRDIVHGISFSIPRGSHIAVVGPSGAGKSSVALALSGLLEFDGAISLGGHNCEMLDLRASVSFVPQSPTLFSGSIKSNIDLARTGVDSDHIHAALLGEELPADLKVGETGKGVSGGQAARISIARGLVKNAAVIVLDEATAQLDYTNARQVRHLAKSLECTLVEITHRPSEALDADFIIVLEDGQLTMMDTPSNVSQHNAFFRTAVMEEEQ

SEQ ID NO: 321 - DNA, 1746 bp, Corynebacterium glutamicum; identical to SEQ ID NO: 319
  CDS (101)..(1723): FRXA02074

SEQ ID NO: 322 - protein, 541 aa, Corynebacterium glutamicum; identical to SEQ ID NO: 320

SEQ ID NO: 323 - DNA, 1527 bp, Corynebacterium glutamicum
  CDS (101)..(1504): RXA02095
ctctcttggtcctctccccacccatttttaagtactcaagacccttccaacagaaaggattactcccccaacaggctcaaaaatactgaaaggctcacgcatgaaaactgagcaatcccaaaaagcacaattagcccctaagaaagcacctgaaaagccacaacgcatccgccaacttatttccgtggcgtggcagcgaccttggctcacctcattcaccgtaatcagcgctttagctgcaacgttgtttgaacttacacttcctcttttgaccggtggcgccatcgatatcgcgctcggaaataccggagatactttaaccactgacctgctggaccggttcactccgagtggattaagcgtgttgaccagcgtcattgcccttatcgtgcttctcgcgttgcttcgctatgccagtcaatttggacggcgatacaccgcaggcaagctcagcatgggggtacagcatgatgtccggcttaaaacgatgcgctcattgcagaacctcgatgggccaggtcaggactctattcgcacaggccaagtagtcagtcggtccatttcggatatcaacatggtgcaaagccttgtggcgatgttgccgatgttgatcggaaatgtggtcaagcttgtgctcactttggtgatcatgctggctatttccccgccgctgaccatcatcgctgcagtgttggtgcctttgctgttgtgggccgtggcctattcgcgaaaagcgctttttgcgtccacgtggtcggcccagcaaaaggctgcggatctgaccactcatgtggaagaaactgtcacgggtatccgcgtggtcaaggcatttgcgcaggaagaccgcgagaccgacaaattggatctcaccgcacgtgagttatttgcccagcgcatgcgcactgcacgtctgacggcaaagttcatccccatggttgagcagcttccgcagcttgctttggtggtcaacattgttggcggtggctatttggccatgactggtcacatcacggtgggcacgtttgtggcgttttcttcctatctcactagcttgtcggcggtggctaggtccctgtcgggcatgctcatgcgcgtgcagttggcgctgtcttctgtggagcgcatctttgaagtcattgatcttcagcctgaacgcaccgatcctgcacaccccctgtcacttcccgacactcccctgggtctgtcgttcaacaacgtagatttccgtgggattctcaacggttttgagctgggtgttcaggccggtgaaaccgttgtgttggtgggccctccaggttcaggcaagaccatggctgtgcagcttgctggaaacttttatcaaccagacagcggccacatcgcctttgatagcaacggccatcgcactcgcttcgacgacctcacccacagcgatatccgcaggaatctcatcgcggtttttgatgagccgttcttgtactcctcctccataccgcgagaacatctcgatgggtttggatgtcagtgatgagcagatcgaacacgcag

SEQ ID NO: 324 - protein, 468 aa, Corynebacterium glutamicum
MKTEQSQKAQLAPKKAPEKPQRIRQLISVAWQRPWLTSFTVISALAATLFELTLPLLTGGAIDIALGNTGDTLTTDLLDRFTPSGLSVLTSVIALIVLLALLRYASQFGRRYTAGKLSMGVQHDVRLKTMRSLQNLDGPGQDSIRTGQVVSRSISDINMVQSLVAMLPMLIGNVVKLVLTLVIMLAISPPLTIIAAVLVPLLLWAVAYSRKALFASTWSAQQKAADLTTHVEETVTGIRVVKAFAQEDRETDKLDLTARELFAQRMRTARLTAKFIPMVEQLPQLALVVNIVGGGYLAMTGHITVGTFVAFSSYLTSLSAVARSLSGMLMRVQLALSSVERIFEVIDLQPERTDPAHPLSLPDTPLGLSFNNVDFRGILNGFELGVQAGETVVLVGPPGSGKTMAVQLAGNFYQPDSGHIAFDSNGHRTRFDDLTHSDIRRNLIAVFDEPFLYSSSIPREHLDGFGCQ

SEQ ID NO: 325 - DNA, 905 bp, Corynebacterium glutamicum
  CDS (1)..(882): RXA02225
caaactgaggagcgctttggcgcagcggctgatgaagccttggcaatcatgttgaaggaagctcgtctgcagtcgttgctgacttttgtgcgccaacttgtcccagcggtgttttctgtgggtcttttggcttatgcgtcactgttggcttttgacggtgacataactggtggtgagatgatctcggtgacgttgctggtgccaccttcgttgactgtgttgggtgtgtcgcttggcatgatgacagagatttgggctaggggacaggcttcgacaaaaagggtccaaaacttagtcactgaactggataaggcggccgctgagccacgacctcagcctgccacctttgaatttgaagaggggatcacggtgtgggatccttcgacacctgaggcacgcgatgtgattgatcgggagttggaggcgcttcaggttcgcgaagatgtcattgtggctcctcaccgcgtcagcgtgtttgaaggtgtgctgaaggataatttgaatccgatgggcactatcgcaccggagatgctgcgcgctgctcttcatgctgcaagttgtgaggacatcttgagccgattgggtgctgatctgaacatgccgggggagtttgagcttccagataccttgatcggcgaggccggattgaatctctccggtggccaacgccagaggattgctttggcacgattcttggctgttgatcctgaggtgctcattttggatgaaccgaccacggggttggatgcggtgaccctggatgaagtggcacatcgcgtcgaaaagcttcgtcgaggccggaaaaccgtcgtcattacgtcgaacccgacgtggcacggcgtcgcaaagcagatgcaatctgatttttcggaaggggtgaagtagatggcgcagcatgagcgcgt

SEQ ID NO: 326 - protein, 294 aa, Corynebacterium glutamicum
QTEERFGAAADEALAIMLKEARLQSLLTFVRQLVPAVFSVGLLAYASLLAFDGDITGGEMISVTLLVPPSLTVLGVSLGMMTEIWARGQASTKRVQNLVTELDKAAAEPRPQPATFEFEEGITVWDPSTPEARDVIDRELEALQVREDVIVAPHRVSVFEGVLKDNLNPMGTIAPEMLRAALHAASCEDILSRLGADLNMPGEFELPDTLIGEAGLNLSGGQRQRIALARFLAVDPEVLILDEPTTGLDAVTLDEVAHRVEKLRRGRKTVVITSNPTWHGVAKQMQSDFSEGVK

SEQ ID NO: 327 - DNA, 1050 bp, Corynebacterium glutamicum
  CDS (101)..(1027): RXA02253
tgaggacatttcccaagtgaaaggcttcggcccgaaacttgcggaggctgtctatgaaggtcttcacgcgtcaaaataagtagatcgctaggatgtaaccatgattcaatccactggggtcacgcacactgataagtctgcacaagaaaatcctgtgaagtacagggacaatttcacacctgtcatcatcaccggtatgtcaggcgcaggtctgagcacagcagcccgagtcctcgaagacttgggttggtatgtggcgcacaatattccaccacagatcatcctggaattaattgatatgtgcgctcgggaagattctcccgtcgacaaagttgcagtcgtgtgcgatgtgcgctcccgtgaattccgcggaagcctcacccaggttgtttcagagctgcgtgataagcagctcgatcccacggtgttatttctggaagcacgcgatgaggtgctgatcaagcgattcgataatgtgcgccgcacccatcctttgcagggcagccaaacccttcaggtgggtattgaacgtgaacgaaccgtgctgtctcctgtgaaggaagacgcttcagtggtcatcgatacctcggatctgtccgtgcatgatttgcgccgcgccatcgaatcctcgtttaggacaatcgccacgcgcacccagcacgtcaccattgaatcattcggtttcaaacacggctcaccacgcgacgccgactttgttgtggacgtgcgtttcttgccgaacccattctgggttccagagctgcgcccatttaggggagtggacaagccagtatctgactatgtgctctcccaaaaaggcgcagaagaatttttgaacaactttgtggacatgctcaaagacatgcttccgggataccgccacgaaggaaaaaacttcatcacaatcggtgtcggctgcaccggtggacaccacagatcagttgcggtgtctgaagaactagccaaaagaatcgcagatcagaccacgctcgacgtgtctgtagtacaccgcgatattaaccgccactaggaaaggggccaactaattga

SEQ ID NO: 328 - protein, 309 aa, Corynebacterium glutamicum
MIQSTGVTHTDKSAQENPVKYRDNFTPVIITGMSGAGLSTAARVLEDLGWYVAHNIPPQIILELIDMCAREDSPVDKVAVVCDVRSREFRGSLTQVVSELRDKQLDPTVLFLEARDEVLIKRFDNVRRTHPLQGSQTLQVGIERERTVLSPVKEDASVVIDTSDLSVHDLRRAIESSFRTIATRTQHVTIESFGFKHGSPRDADFVVDVRFLPNPFWVPELRPFRGVDKPVSDYVLSQKGAEEFLNNFVDMLKDMLPGYRHEGKNFITIGVGCTGGHHRSVAVSEELAKRIADQTTLDVSVVHRDINRH

SEQ ID NO: 329 - DNA, 558 bp, Corynebacterium glutamicum
  CDS (101)..(535): RXN01881
accggccctgcggcctcaaccgccgaccagcgcggcgcacacattttgactgtttcataataaagacaaacttaagtatcggagtcgaagaaaaaccacaatggccaatctgattaatctcgagaacgtctccaaaacctggggattaaaaacgcttctcgacggtgtctccttaggtgttcaaaccggcgaccgcattggcgtcgtcggcctcaatggtggcggaaaaaccaccctgctggaagtacttactggcatcgaaaagccggatcagggccgtgtgtctcacaactctgacctgcgcatggctgtggtgacgcagcgtgctgaactcaatgatgacgacaccgtcgctgacgtggtgcttggacctttgggtttggaagttttcgaatgggcatcaaacgccacggtgcgcgacgtcctcggtggcttgggcattgtcgatcttggccttgacaccaaggtgggcaaaccttttccggtgggcgaagcgccgacgcaccaacctggccgccgcgctggttcgcgaccttgacctgatcgtgctcgacgagc

SEQ ID NO: 330 - protein, 145 aa, Corynebacterium glutamicum
MANLINLENVSKTWGLKTLLDGVSLGVQTGDRIGVVGLNGGGKTTLLEVLTGIEKPDQGRVSHNSDLRMAVVTQRAELNDDDTVADVVLGPLGLEVFEWASNATVRDVLGGLGIVDLGLDTKVGKPFPVGEAPTHQPGRRAGSRP

SEQ ID NO: 331 - DNA, 564 bp, Corynebacterium glutamicum
  CDS (101)..(541): FRXA01881
accggccctgcggcctcaaccgccgaccagcgcggcgcacacattttgactgtttcataataaagacaaacttaagtatcggagtcgaagaaaaaccacaatggccaatctgattaatctcgagaacgtctccaaaacctggggattaaaaacgcttctcgacggtgtctccttaggtgttcaaaccggcgaccgcattggcgtcgtcggcctcaatggtggcggaaaaaccaccctgctggaagtacttactggcatcgaaaagccggatcagggccgtgtgtctcacaactctgacctgcgcatggctgtggtgacgcagcgtgctgaactcaatgatgacgacaccgtcgctgacgtggtgcttggacctttgggtttggaagttttcgaatgggcatcaaacgccacggtgcgcgacgtcctcggtggcttgggcattgtcgatcttggccttgacaccaaggtggggcaaaccttttccggtgggcgaagcgccgacgcaccaacctggccgccgcgctggttcgcgaccttgacctgatcgtgctcgacgagcccacc

SEQ ID NO: 332 - protein, 147 aa, Corynebacterium glutamicum
MANLINLENVSKTWGLKTLLDGVSLGVQTGDRIGVVGLNGGGKTTLLEVLTGIEKPDQGRVSHNSDLRMAVVTQRAELNDDDTVADVVLGPLGLEVFEWASNATVRDVLGGLGIVDLGLDTKVGQTFSGGRSADAPTWPPRWFATLT

SEQ ID NO: 333 - DNA, 813 bp, Corynebacterium glutamicum
  CDS (101)..(790): RXA00526
ggtggagcaggcggcggctccttttagtcctgcggccccttttgaccctgcagcccctgccgtttctgccaagcaaaccgtgggccaggtgatttagcctatgagcctcatcgaaatgcgaaatattgtcaagacctacaacattggatctgaaggtgaactcaccgtgttgcacggtgtggatttccatgtggaccgtggcgaattcgtgtcggttgtgggtacgtccggctcaggtaaatcaacgatgatgaacatcattgggttgttggataagccaactgatggcacgtacaccttggatggcgtggatgtgttggatatcagcgatgatgctttggcgagccaccgcgctaaatcgattggttttgtgtttcagaacttcaatctgattggccggatcgatgcgttgaagaatgtggaaatgcccatgatgtatgcgggcattccggctaagcagcggagaagtcgtgcggttgaattattggaaatggtcgggatgggtgagcgtctcaaccatgagcccaatgagctttcgggtggtcagaagcagcgcgtggccattgctcgcgcgttggcgaacgatcctgagatcattcttgctgatgaaccaactggtgcgttggattctgcaacgggccggatggtgatggatattttccaccagctcaacaaggagcagggcaaaaccatcgtgtttattactcacaaccctgagcttgctgatgaatctgatcgggtggtcaccatggttgacgggcgcatcattgggtctgaggtgaaacactcatgagccttgcagaatcaattctt

SEQ ID NO: 334 - protein, 230 aa, Corynebacterium glutamicum
MSLIEMRNIVKTYNIGSEGELTVLHGVDFHVDRGEFVSVVGTSGSGKSTMMNIIGLLDKPTDGTYTLDGVDVLDISDDALASHRAKSIGFVFQNFNLIGRIDALKNVEMPMMYAGIPAKQRRSRAVELLEMVGMGERLNHEPNELSGGQKQRVAIARALANDPEIILADEPTGALDSATGRMVMDIFHQLNKEQGKTIVFITHNPELADESDRVVTMVDGRIIGSEVKHS

SEQ ID NO: 335 - DNA, 1008 bp, Corynebacterium glutamicum
  CDS (101)..(985): RXN00733
acggcgaggttgtcggtattggaacgcacacgaatttgctgaacacgtgcggtacctaccgtgaaattgttgaatcccaagagactgcgcaggcgcaatcatgagtaatactgcaggcccccgcgggcgttcccatcaggcagacgccgcgccgaatcaaaaggcacagaatttcggaccatctgccaaaaggcttttcggaattctaggccatgaccgtaacaccttaatttttgttatcttcctagccgtcctgagcgttggacttaccgtcttgggcccatggttgctgggtaaagccaccaacgtggtgtttgaaggattcctatctaagcgcatgccggctggtgcgtcaaaggaagatatcatcgcgcagttgcaggctgcaggtaaacataatcaggcttccatgatggaagacatgaaccttgttccaggctcaggcattgattttgaaaaattagccatgatcctcggactggtgatcggtgcttatctcatcggtagcctgttgtcgttgttccaggcgcggatgctcaaccgcatcgtgcaaagtgccatgcaccggctgcgcatggaggtggaggaaaaaatccaccgcctaccgctgagctatttcgattccatcaaacgtggtgatctgcttagccgtgtgaccaacgatgtggataatatcggtcaatccctgcaacaaaccttgtcacaggcgatcacttccctactgaccgtcatcggtgtgttggtgatgatgtttatcatctccccactgctcgcactcgtggcgctggtatccattccggtcaccatcgtggtcactgtggtggttgcgagccgttcccagaaactctttgcggaacagtggaagcagaccggtattttgaatgcgcgcctggaggaaacctactctggccacgccgtggttaaggttttcggacaccaaaaggatgttcaagaagcattcgaggaagaaaatcaagcttgtgtataaggccagctttggtgcccagt

SEQ ID NO: 336 - protein, 295 aa, Corynebacterium glutamicum
MSNTAGPRGRSHQADAAPNQKAQNFGPSAKRLFGILGHDRNTLIFVIFLAVLSVGLTVLGPWLLGKATNVVFEGFLSKRMPAGASKEDIIAQLQAAGKHNQASMMEDMNLVPGSGIDFEKLAMILGLVIGAYLIGSLLSLFQARMLNRIVQSAMHRLRMEVEEKIHRLPLSYFDSIKRGDLLSRVTNDVDNIGQSLQQTLSQAITSLLTVIGVLVMMFIISPLLALVALVSIPVTIVVTVVVASRSQKLFAEQWKQTGILNARLEETYSGHAVVKVFGHQKDVQEAFEEENQACV

SEQ ID NO: 337 - DNA, 508 bp, Corynebacterium glutamicum
  CDS (101)..(508): FRXA00733
acggcgaggttgtcggtattggaacgcacacgaatttgctgaacacgtgcggtacctaccgtgaaattgttgaatcccaagagactgcgcaggcgcaatcatgagtaatactgcaggcccccgcgggcgttcccatcaggcagacgccgcgccgaatcaaaaggcacagaatttcggaccatctgccaaaaggcttttcggaattctaggccatgaccgtaacaccttaatttttgttatcttcctagccgtcctgagcgttggacttaccgtcttgggcccatggttgctgggtaaagccaccaacgtggtgtttgaaggattcctatctaagcgcatgccggctggtgcgtcaaaggaagatatcatcgcgcagttgcaggctgcaggtaaacataatcaggcttccatgatggaagacatgaaccttgttccaggctcaggcattgattttgaaaaattagccatgatcctcggactggtgatcggtgcttatctcattcgtagc

SEQ ID NO: 338 - protein, 136 aa, Corynebacterium glutamicum
MSNTAGPRGRSHQADAAPNQKAQNFGPSAKRLFGILGHDRNTLIFVIFLAVLSVGLTVLGPWLLGKATNVVFEGFLSKRMPAGASKEDIIAQLQAAGKHNQASMMEDMNLVPGSGIDFEKLAMILGLVIGAYLIRS

SEQ ID NO: 339 - DNA, 692 bp, Corynebacterium glutamicum
  CDS (1)..(669): RXA00735
ggtcccaccggtgcgggcaagaccacattggtgaatctgatcatgcgtttctacgacatcaacagcggttccatcactcttggtgaaacagcacaagacgccgtggatatccgcaccatggctagagaagatctgcgatcacgaaccggcatggtgttgcaggatacgtggctgtttgccggaaccatcagggataacattctttacggtagacctgaagcaactgaggaagaaatgcttgctgcgtccaaggccgcctacgtggatcgttttgtccgttccctgccagaaggctacgacaccgtacttgatgatgaagccatgaacctatcggtgggtgaacgccagctgatcaccatcgcgcgtgcattcttggctaatccccgactgctgattctggatgaagccacctcatcggtggatacgcgtaccgaattgttgattcagcgcgccatgtccaagctgcgccaagaccgcaccgccttcgtcatcgcgcaccggttgtccacgattcgtgatgccaacctgattttgatgatgaaagacggcgagatcgtggagcagggcaatcaccgtgagttgatggccctggagggcgcatattgggagttgtataactcccaattcaacgcccccgcgaaagaagaattacaggctgacggagatcactgatgatttcttcttaggctttc

SEQ ID NO: 340 - protein, 223 aa, Corynebacterium glutamicum
GPTGAGKTTLVNLIMRFYDINSGSITLGETAQDAVDIRTMAREDLRSRTGMVLQDTWLFAGTIRDNILYGRPEATEEEMLAASKAAYVDRFVRSLPEGYDTVLDDEAMNLSVGERQLITIARAFLANPRLLILDEATSSVDTRTELLIQRAMSKLRQDRTAFVIAHRLSTIRDANLILMMKDGEIVEQGNHRELMALEGAYWELYNSQFNAPAKEELQADGDH

SEQ ID NO: 341 - DNA, 1986 bp, Corynebacterium glutamicum
  CDS (101)..(1963): RXA00878
cgagattaggtccgcttcagttgtggtggctccgaatctgatgaacaatgatcattcctaattcatttacatctttatcaaagagagccaccacctactaatgcgacttcttggtcgaattttaaaaaccacgtctgcgctttggccctactatctcggaattatcgtcgtatccattgtgatcgcggcgttgtcgctgctgtcgccgtttattctccgcgaagcaacagattccattgtttctgcagtaaccggatctaacaccgtcgatgcagttactcgcactattattttcttagctttagccctgtttgtcgcaagcttcctcaatacggtgatgaccaacatcggtggctacatcggtgatgtcatggcatctcgtatgcgccagattctggccacgcgctattacgcaaagctgttggcgctgcctcagaagtattttgataatcaggtcaccggcaccatcatcgcccgccttgatcgatcaatcaacggcatcacgcagttcatgcagagcttctccaacaacttcttccccatgctcatcaccatggtggcagtgctgattatttccgcgattttctactggcctctggcaattctgctggccatgttgttcccgatttacatgtggctgacggcgttgacatcgaaacgctggcagaaatatgagggcgagaaaaaccatgaaatcgacgtggctaacggccgcttcgctgaggttgtcggccaggtcaaggttgttaaatcattcgtcgcagagacccgcgagctggctgatttcggtgggcgttacggcaaaacagtagcgattacccggccgcaatccggttggtggcaccgcatggatactctccgtggcgcggcactaaatatcatcttcctggccattcacctgctgattttctaccgcaccttgcacggccatttcaccatcggcgacatggtcatgctcatccagcttgtcaccatggcgcagcaaccggtgtacatgatgagctacatcgtcgactccgcgcagcgcgccatcgccggctcccgcgactacttcgaggtcatggcgcagcaggtcgagcccaccgccaataaggagcttgtcgacgccaccctcgcctcagacactccacgcatcagtgtgggcacgcccgccgcgctgcccgctggagaaccagcgatggaattcaaaaacgtcaccttcgcctacgaagaaggcaagccggttatttccgacgtgtccattaccgcccgccacggcgagcgcatcgcgttggtcggtgaatccggcggcggtaaatccaccctggtcaaccttctgttaggtctgtacaaaccaaacagcggcagccttgcagtatgtggcgtggatgttaaagatctgacttccgaggaacttcgcgcatccgtgggtgtggtcttccaggacgccagcttgttctctggatctattgcagaaaacatcgcctacggtcgcccaggtgccacccgcgaagagatcatcgaagtggctaagaaagccaacgcacatgagttcatttccgccttccctgaaggatatgaaaccgtcgtcggtgaacgcggactcaaactttctggtggccagaagcagcgcgtctctgtggcacgggccatgcttaaagatgccccacttcttgttctcgatgaagccacctctgcactggataccaagtctgagcaggcagtccaagccggtttggaacagctgatggaaaaccgcaccaccttaatgatcgcccaccgcctgtccaccatcgcaggcgtcgataccatcgtgaccatccaaaacggacgggttgaagaggtcggatctcctaccgagctcgcagtctcaggcggtatctattccgaactgctgcgcctgaccaactccacagcagaagccgaccgggagcgtctgcgcgcctttggtttcactggcgatgcaccagctgaagaagaggactagccccgcgaaagaacaatccc

SEQ ID NO: 342 - protein, 621 aa, Corynebacterium glutamicum
MRLLGRILKTTSALWPYYLGIIVVSIVIAALSLLSPFILREATDSIVSAVTGSNTVDAVTRTIIFLALALFVASFLNTVMTNIGGYIGDVMASRMRQILATRYYAKLLALPQKYFDNQVTGTIIARLDRSINGITQFMQSFSNNFFPMLITMVAVLIISAIFYWPLAILLAMLFPIYMWLTALTSKRWQKYEGEKNHEIDVANGRFAEVVGQVKVVKSFVAETRELADFGGRYGKTVAITRPQSGWWHRMDTLRGAALNIIFLAIHLLIFYRTLHGHFTIGDMVMLIQLVTMAQQPVYMMSYIVDSAQRAIAGSRDYFEVMAQQVEPTANKELVDATLASDTPRISVGTPAALPAGEPAMEFKNVTFAYEEGKPVISDVSITARHGERIALVGESGGGKSTLVNLLLGLYKPNSGSLAVCGVDVKDLTSEELRASVGVVFQDASLFSGSIAENIAYGRPGATREEIIEVAKKANAHEFISAFPEGYETVVGERGLKLSGGQKQRVSVARAMLKDAPLLVLDEATSALDTKSEQAVQAGLEQLMENRTTLMIAHRLSTIAGVDTIVTIQNGRVEEVGSPTELAVSGGIYSELLRLTNSTAEADRERLRAFGFTGDAPAEEED

SEQ ID NO: 343 - DNA, 1713 bp, Corynebacterium glutamicum
  CDS (101)..(1690): RXN01191
cgctgctttcacgcaactgaaaccgcaccggatcaagttatttggggttgttctttgtggcgtgttggtggccgtcgcggggttggtagggccctgggcggtgggtggactcgtcgataagctccttgcaaccccgagcatgcgcgacgttgtagtgttcgcgctgcttatcgtggctggcggcgttgtttcgagcctgggcacgtggtggggcagcgcgctgatggcgcgcgcgttggagccggcgatcgcggggctgcgcgaggatgtgttgcgcgcggcggtgagtttggatgcgaacacgattgaaacggcggggcgcggcgacgtgatttcgcgtatcgcggatgattcgcgggaggtgtccactgcggcgagcaccgtggtgccgctgatggtgcaggcgggctttaccgtggtgatttccgcgtttggcatggcggcggttgattggcgcctcggccttgtcggtttggtcgcgatcccgctgtattggaccacgttgcgcgtctatttaccccgctcaggtccgctttatacgcgtgagcgcgaggcctttggggtgcgcacgcagcggcttgtcggcgcagtcgaaggcgcggaaaccttgcgcgctttccgcgcagaagatacagaattaaagcgtatcgacgcagcctccggcgaagcccgcgacatttccatttctgttttcaggttcctcacatgggcattttcccgcaacaaccgcgcggaatgcatcaccctcgtgctcatcttgggcaccggcttttacctggtcaacatcgatctggtcaccgtcggcgcagtctcaaccgccgcactgatcttccaccgactcttcggtccaatcggcacgctcgtgggcatgttctccgacatccaatccgccagcgcatcgctgatccgcatggtgggcgttattaacgcggcatcgaaccaggtcagcggcacctcgccggcgtctgccagcaccgctttaacgcttttcgacgtctcccaccactatcacactgcacccgtcatcaagaatgcatccgtgcagctggaaccaggggaacacatcgccattgtgggtgcgaccggcgctggtaaaagcacgctcgccctcattgcggcaggcctgctcagcccaacttccgggcaggtggctctcggcggatcgagtttttctaacgtcgaaccggaagcattgcgccagaagatcgcgatggtcagccaagaaatccactgcttccgaggatctgttttagataatcttcgtatcgcacgccccgaagccaccgatgcggacatccacgccgttctcgccgatattggtgattcctggttggagcgcttaccgcaaggcatagacaccatcgtgggtgatggcgctttccgtttaacctctgtggaaaaccagatcatggcgcttgctcgcgtacatttggccgacctagcaatcgtcatccttgatgaagcaacggctgaatcaggctctgatcatgcaaaacagcttgaagatgcagcccttaaagtcactgaaaacagatcagccatcatcgtggctcaccgcctcaaccaagcgaaaaccgccgatcgcatcatcgtcatggactccggagaaatcatagaatctggaacccatgaagagcttcgagcgatcggcggccgatatgaacaactgtggactgcgtggtctgcgcgctaattagccacccaagaccacgc

SEQ ID NO: 344 - protein, 530 aa, Corynebacterium glutamicum
VGGLVDKLLATPSMRDVVVFALLIVAGGVVSSLGTWWGSALMARALEPAIAGLREDVLRAAVSLDANTIETAGRGDVISRIADDSREVSTAASTVVPLMVQAGFTVVISAFGMAAVDWRLGLVGLVAIPLYWTTLRVYLPRSGPLYTREREAFGVRTQRLVGAVEGAETLRAFRAEDTELKRIDAASGEARDISISVFRFLTWAFSRNNRAECITLVLILGTGFYLVNIDLVTVGAVSTAALIFHRLFGPIGTLVGMFSDIQSASASLIRMVGVINAASNQVSGTSPASASTALTLFDVSHHYHTAPVIKNASVQLEPGEHIAIVGATGAGKSTLALIAAGLLSPTSGQVALGGSSFSNVEPEALRQKIAMVSQEIHCFRGSVLDNLRIARPEATDADIHAVLADIGDSWLERLPQGIDTIVGDGAFRLTSVENQIMALARVHLADLAIVILDEATAESGSDHAKQLEDAALKVTENRSAIIVAHRLNQAKTADRIIVMDSGEIIESGTHEELRAIGGRYEQLWTAWSAR

SEQ ID NO: 345 - DNA, 1430 bp, Corynebacterium glutamicum
  CDS (1)..(1407): FRXA01191
gtgagtttggatgcgaacacgattgaaacggcggggcgcggcgacgtgatttcgcgtatcgcggatgattcgcgggaggtgtccactgcggcgagcaccgtggtgccgctgatggtgcaggcgggctttaccgtggtgatttccgcgtttggcatggcggcggttgattggcgcctcggccttgtcggtttggtcgcgatcccgctgtattggaccacgttgcgcgtctatttaccccgctcaggtccgctttatacgcgtgagcgcgaggcctttggggtgcgcacgcagcggcttgtcggcgcagtcgaaggcgcggaaaccttgcgcgctttccgcgcagaagatacagaattaaagcgtatcgacgcagcctccggcgaagcccgcgacatttccatttctgttttcaggttcctcacatgggcattttcccgcaacaaccgcgcggaatgcatcaccctcgtgctcatcttgggcaccggcttttacctggtcaacatcgatctggtcaccgtcggcgcagtctcaaccgccgcactgatcttccaccgactcttcggtccaatcggcacgctcgtgggcatgttctccgacatccaatccgccagcgcatcgctgatccgcatggtgggcgttattaacgcggcatcgaaccaggtcagcggcacctcgccggcgtctgccagcaccgctttaacgcttttcgacgtctcccaccactatcacactgcacccgtcatcaagaatgcatccgtgcagctggaaccaggggaacacatcgccattgtgggtgcgaccggcgctggtaaaagcacgctcgccctcattgcggcaggcctgctcagcccaacttccgggcaggtggctctcggcggatcgagtttttctaacgtcgaaccggaagcattgcgccagaagatcgcgatggtcagccaagaaatccactgcttccgaggatctgttttagataatcttcgtatcgcacgccccgaagccaccgatgcggacatccacgccgttctcgccgatattggtgattcctggttggagcgcttaccgcaaggcatagacaccatcgtgggtgatggcgctttccgtttaacctctgtggaaaaccagatcatggcgcttgctcgcgtacatttggccgacctagcaatcgtcatccttgatgaagcaacggctgaatcaggctctgatcatgcaaaacagcttgaagatgcagcccttaaagtcactgaaaacagatcagccatcatcgtggctcaccgcctcaaccaagcgaaaaccgccgatcgcatcatcgtcatggactccggagaaatcatagaatctggaacccatgaagagcttcgagcgatcggcggtcgatatgaacaactgtggactgcgtggtctgcgcgctaattagccacccaagaccacgc

SEQ ID NO: 346 - protein, 469 aa, Corynebacterium glutamicum
VSLDANTIETAGRGDVISRIADDSREVSTAASTVVPLMVQAGFTVVISAFGMAAVDWRLGLVGLVAIPLYWTTLRVYLPRSGPLYTREREAFGVRTQRLVGAVEGAETLRAFRAEDTELKRIDAASGEARDISISVFRFLTWAFSRNNRAECITLVLILGTGFYLVNIDLVTVGAVSTAALIFHRLFGPIGTLVGMFSDIQSASASLIRMVGVINAASNQVSGTSPASASTALTLFDVSHHYHTAPVIKNASVQLEPGEHIAIVGATGAGKSTLALIAAGLLSPTSGQVALGGSSFSNVEPEALRQKIAMVSQEIHCFRGSVLDNLRIARPEATDADIHAVLADIGDSWLERLPQGIDTIVGDGAFRLTSVENQIMALARVHLADLAIVILDEATAESGSDHAKQLEDAALKVTENRSAIIVAHRLNQAKTADRIIVMDSGEIIESGTHEELRAIGGRYEQLWTAWSAR

SEQ ID NO: 347 - DNA, 1047 bp, Corynebacterium glutamicum
  CDS (101)..(1024): RXN01212
tttagaagccacatgacatatgtcatgaaaattatgtgcaaagtgcagtaatactcctgacatatggctctaccagcgccaatgcgaagtaggaagaattatgcctatgacaacgacaccagcaatcgacgtaacagacctcgtgagaacctacggcgactacaccgcagtcaagggcctgaatttccatgtacagcgcggtgaagtatttggtctgctcggcaccaacggggccggcaaaacctccaccttggaagtcatcgaaggactttccgcacccagctccggcaccgtgcgcatctccgggcttgaccccgttgccgaccgcgcgatcctgcgccccgagctcggcatcatgctgcaatcaggcggcctgccatcacagctcaccgtcgccgaaaccatggacatgtggcacggcacctgcacgtatccgcgcgccattaaagatgtgcttgccgacgtcgacctcctacaccgcgaaaacgtcaaggtcggcgcgctttccggaggcgaacaacgacgccttgatttggcctgcgcactgcttggcgacccctcaattttgttcctcgacgaacccaccaccggcctcgacccagaatctaggcgccacacctggcaactcctgctggacctgaaacagcgcggcgtcaccatgatgctgaccacccactacctggaggaagccgaattcctctgcgaccggattgccatcatgaacgccggtgagatcgcagtggaaggcaccttggatgaactggtggcccgcgagaagtcgatcatcagtttcgtgctgcgtggcgggcaggtggagttgccggtcttgagtggggctgaaatcatccgcgacaacaaccacgtccgcatcgccaccaccaccctgcagcagcacaccttagaaatacttacctgggctgcagagaccgggatcgcgctggaaggcttcgctgcaaaacccgccaccttggaatccgtattcatggacatcgcctcactcgagaacacctcgctgcaaaccgcctagaatctttaaggagaccacaa

SEQ ID NO: 348 - protein, 308 aa, Corynebacterium glutamicum
MPMTTTPAIDVTDLVRTYGDYTAVKGLNFHVQRGEVFGLLGTNGAGKTSTLEVIEGLSAPSSGTVRISGLDPVADRAILRPELGIMLQSGGLPSQLTVAETMDMWHGTCTYPRAIKDVLADVDLLHRENVKVGALSGGEQRRLDLACALLGDPSILFLDEPTTGLDPESRRHTWQLLLDLKQRGVTMMLTTHYLEEAEFLCDRIAIMNAGEIAVEGTLDELVAREKSIISFVLRGGQVELPVLSGAEIIRDNNHVRIATTTLQQHTLEILTWAAETGIALEGFAAKPATLESVFMDIASLENTSLQTA

SEQ ID NO: 349 - DNA, 813 bp, Corynebacterium glutamicum
  CDS (1)..(813): FRXA01212
ggcctgaatttccatgtacagcgcggtgaagtatttggtctgctcggcaccaacggggccggcaaaacctccaccttggaagtcatcgaaggactttccgcacccagctccggcaccgtgcgcatctccgggcttgaccccgttgccgaccgcgcgatcctgcgccccgagctcggcatcatgctgcaatcaggcggcctgccatcacagctcaccgtcgccgaaaccatggacatgtggcacggcacctgcacgtatccgcgcgccattaaagatgtgcttgccgacgtcgacctcctacaccgcgaaaacgtcaaggtcggcgcgctttccggaggcgaacaacgacgccttgatttggcctgcgcactgcttggcgacccctcaattttgttcctcgacgaacccaccaccggcctcgacccagaatctaggcgccacacctggcaactcctgctggacctgaaacagcgcggcgtcaccatgatgctgaccacccactacctggaggaagccgaattcctctgcgaccggattgccatcatgaacgccggtgagatcgcagtggaaggcaccttggatgaactggtggcccgcgagaagtcgatcatcagtttcgtgctgcgtggcgggcaggtggagttgccggtcttgagtggggctgaaatcatccgcgacaacaaccacgtccgcatcgccaccaccaccctgcagcagcacaccttagaaatacttacctgggctgcagagaccgggatcgcgctggaaggcttcgctgcaaaacccgccaccttggaatccgtattcatggac

SEQ ID NO: 350 - protein, 271 aa, Corynebacterium glutamicum
GLNFHVQRGEVFGLLGTNGAGKTSTLEVIEGLSAPSSGTVRISGLDPVADRAILRPELGIMLQSGGLPSQLTVAETMDMWHGTCTYPRAIKDVLADVDLLHRENVKVGALSGGEQRRLDLACALLGDPSILFLDEPTTGLDPESRRHTWQLLLDLKQRGVTMMLTTHYLEEAEFLCDRIAIMNAGEIAVEGTLDELVAREKSIISFVLRGGQVELPVLSGAEIIRDNNHVRIATTTLQQHTLEILTWAAETGIALEGFAAKPATLESVFMD

SEQ ID NO: 351 - DNA, 999 bp, Corynebacterium glutamicum
  CDS (101)..(976): RXA02749
caacctagacttcggtaagaagtaactttgctttagttggtcggcgcatcactttccctaagcgatgcgccgattacttgtttttgctacaaatttaactatgtcacccatcctaaaagtgcgggacctcgtcaaacgctatggcgacaccgttgcggttgacggtttaaattttgatgtttcacaaggggaaatttttgcctttctaggggagaacggcgcaggaaaaacaaccacgatttcatgcctgattggcattgatcaagccacctctggggagatcgaactgcagggtggccaagtagattctgaaaaacttggagtggtgtttcaacaatccgtcttagaccctttgctgagtgccaaagaaaacttggaaacacgcggacagctgtacccaggggtggggaagcagcgggttgcacagctcattgagcaaatcgggatggaagggtttgcggaccgccgatacggagtgttgtcgggcggtgaaaaacgtcgcaccgacatcgcacgagctttactgcacagcccagacattctttttcttgatgaacccacagcaggcctcgaccccagatcacgacgccaagtttgggacaccatcaattccctgcgtaacgatgtgggcctcactgtctttttgaccactcactacatggaagaaacagaactggctgattcagttctaatcattgaccgtggcaaagaggtcgcatcaggaaccccgatggaactgcgcgcccgttacaccacaacagaattgactcttagaacaaacgaccctactcattcgggtaaagagttggcccacttgagcccagaaatcgacggtgaccgactgcggatcaagttggaaaatgggctcgaagctgcgcgcctggcaacagaactagatggggttctcgacgtagagatccgccacggttccatggacgatgtatttctagcagttacagctgaacggaaacgatcatgattacagttctgacacgcaga

SEQ ID NO: 352 - protein, 292 aa, Corynebacterium glutamicum
MSPILKVRDLVKRYGDTVAVDGLNFDVSQGEIFAFLGENGAGKTTTISCLIGIDQATSGEIELQGGQVDSEKLGVVFQQSVLDPLLSAKENLETRGQLYPGVGKQRVAQLIEQIGMEGFADRRYGVLSGGEKRRTDIARALLHSPDILFLDEPTAGLDPRSRRQVWDTINSLRNDVGLTVFLTTHYMEETELADSVLIIDRGKEVASGTPMELRARYTTTELTLRTNDPTHSGKELAHLSPEIDGDRLRIKLENGLEAARLATELDGVLDVEIRHGSMDDVFLAVTAERKRS

SEQ ID NO: 353 - DNA, 1920 bp, Corynebacterium glutamicum
  CDS (101)..(1897): RXA02224
gcttcgtcgaggccggaaaaccgtcgtcattacgtcgaacccgacgtggcacggcgtcgcaaagcagatgcaatctgatttttcggaaggggtgaagtagatggcgcagcatgagcgcgttgcggatgcgctgcagccggcgtcgttggcggagtcgtggcgtgagctgaaaacgatgccttcggggcccaaggcctggtggtatgtgagtttcgtggttattagcgtggtcacggtcgtggcgatggtcggcacgtccaacttgttgggctattccgttgatctgatcaatgggcagtcgttgccgctgatcggttcaggatcgaccgcaatgatctggttgcttggtttggtgggcgctggaattttagcagaaactgccggtcgcgcgctgctgcaattggtgatcaacaccttggcacgtcgcctgtcggtggatctgcggaaagctgcgctgtcttcggcgttgcgtgcaccggttcctgatgtcatggaattgggcacgggaaacgtgattagccgcctgacgcaagacatcgataacactgtgcgcatcgtcggcatggtaggtgtgcgtttggtgatcaccattttgattctgcccagctccttgttcgcgttgatgaccattcactggacctttgtgatcctgttcatcgcagtgattgtggtgctgattcccagcggtcggaaagccgtgcgagctattccttcggcaacaaatattgtgtccagtacggaggcgcgtcgaaacaatctgctcctcgatacgatccgtggcattgaaacactgcgtgtgctcaagctcggtgcgtggggtgtgcagcggatgcgccaagcgtcgtggactgcggtgcaagcaacagctgatcgcgcgccgattttcactcgtctgctcgcccttggttcgattgcttatggcctgctgctaattggcgtgtttgggctcagtgcgttttgggttgcccaggatgcgatgagcattggagcggcaacggcagcagttttcgtggttgtgcgcatggaaattcacgtgttcaacgtgctgttcttcgcatcggaaattcagagtgcgtctacttctcttggtcgcgcggtgtcccttgcccagatggctcgtcgcaccgaacagctgtctgagtctgccgattgcacagaaccaccctccgtgactgtgcaggacgtgacgtttaaatatcccggcggcgtggccattttggaggatttcaatctggtcttggaagcaggaacaaccacagcgctggtcggtacttctggtgcgggaaaatccacgctcgcgggcgtcattgcggggctgcagcgccctgattccggcgccgttttggtcgggggcatcaacaccgccaccgtcaccgacacgtggactacccgccaggttgcgctgatcagccaggaagtccaccttttcgcaggcactctggcagaggatcttcgcatggccaatgcgcacgccaccgacgcgcagctccacgcagcgctcgagtcggtcgggctcgggcaaatgacaactgcttttcgacgtttctttccatccggattagacaccaaaattggcgccggcgcagaagaactcacccctgaaatccaacagcaaatctctcttgcccgcatcgtgctccgcaatccacctgtgttgatcatggatgaagccaccagtgaagccggcagcgatgatgcccgcatgttggaaaaagccgccacagaaatcgcacgaaaccgcaccaccttggttgttgcgcaccgccttgaccaagcagttgtcgcagatcgcatcatcgtgatggaacaaggcacaatcaccgaagacggcactcaccaggaattacttgcttttgagggccgctacgcgcagctgtatcaacgatggagtgctcaatagttcaaatccaccacaaactc

SEQ ID NO: 354 - protein, 599 aa, Corynebacterium glutamicum
MAQHERVADALQPASLAESWRELKTMPSGPKAWWYVSFVVISVVTVVAMVGTSNLLGYSVDLINGQSLPLIGSGSTAMIWLLGLVGAGILAETAGRALLQLVINTLARRLSVDLRKAALSSALRAPVPDVMELGTGNVISRLTQDIDNTVRIVGMVGVRLVITILILPSSLFALMTIHWTFVILFIAVIVVLIPSGRKAVRAIPSATNIVSSTEARRNNLLLDTIRGIETLRVLKLGAWGVQRMRQASWTAVQATADRAPIFTRLLALGSIAYGLLLIGVFGLSAFWVAQDAMSIGAATAAVFVVVRMEIHVFNVLFFASEIQSASTSLGRAVSLAQMARRTEQLSESADCTEPPSVTVQDVTFKYPGGVAILEDFNLVLEAGTTTALVGTSGAGKSTLAGVIAGLQRPDSGAVLVGGINTATVTDTWTTRQVALISQEVHLFAGTLAEDLRMANAHATDAQLHAALESVGLGQMTTAFRRFFPSGLDTKIGAGAEELTPEIQQQISLARIVLRNPPVLIMDEATSEAGSDDARMLEKAATEIARNRTTLVVAHRLDQAVVADRIIVMEQGTITEDGTHQELLAFEGRYAQLYQRWSAQ

SEQ ID NO: 355 - DNA, 1653 bp, Corynebacterium glutamicum
  CDS (101)..(1630): RXN01602
tgcaggccacatgcctcccagtgccgtctctgcacgttgattttcccctgccacgactggtcgcagggcgactttctagcacttttaaaggaattttttaatggctaaaacccatattcggttacaggacctttccctgtcatacacctcaaccccgttaattacgaagctcaatatcactgtttcttctggacagtgcgcagtgattgttggtgagaatggtcgaggtaaaaccacacttctgcgagcactggctcgagaattcccgccatctgcaggtgagattctcactcatggcacggtagcaattgctcatcaacacatgcctgcaggtgatctgtccgtcggagagatctgtgatgaggcaattcgtgattcaaagaatgctctcgaagagcttgagagagctggagctctacttgagacaaacactgcgcacgcacttgatggatatcaacaagcccttgatgccgctgaagtgcttgacgcatggaacgctgaacatcgattagaaaaagctctgcgcagctttggcgcgatcaccgatagatcccgtgcactcagtgagctatcgatcgggcaaaggtatcgggtacggctggcctgcctcatcggtggcgatgctgatattttgcttctcgatgaacccaccaatcatcttgaccggggcgcgcttaactatctcaccgaagccataacctcccacaaaggtgtggtacttgttgtttctcatgatcaagcactgatcaaagatgtcgcggatttcatcatcgatattgattcaaccccagacggcctaccacggatctatcatgagggttttgattcttatcgacgccaaaggagtgcgcttcttgaaacttggaggcaggattatgccgctgcacaaactgtgcaacagcaattgcaggaggatctagagcacgcacgccagcgggtgaattcttcgtggaaacctccaaaaggaacgggaaaacacactcgcgcatctcgggctcccggagtggtgcaggccttaaagcgagcacaggatgcgttggatagcaaagcgttggacgttcccccggctccggccccattgcttctgcctaccttgaaagtgcgaccagataaacccatggtggacttttcggacctttttgtaccccaccgcttgcgtctgccaggctcacattcagtggtatcaggtgacaaaatagtgatcactggtgacaacggcgctggcaaatcaacgctcatcgaagtcttgtctggggttttgactccggcaagtggttcggttgcaaaccatgcccgaactggggttctcggccaagaatcacttgtcggcgaggtgccatcaatagcacgagatcacgcagttaagtggggacttttaagtgttgaggagagccgatttgccctacaggaattctcaattggtcaacgcagaagactagatttggccatgtcgttagctggcaatcctgaactgttgcttctcgatgaaccttcgaaccatctgtctatgcacttggtttccgcacttacagagtggctggacacgaccgcggctgcagtgatcatggtaacgcatgatcgacagctactccgcgatacggctcattggaggcacatcgagttgaaatcttaagaattcgcaagggctttcac

SEQ ID NO: 356 - protein, 510 aa, Corynebacterium glutamicum
MAKTHIRLQDLSLSYTSTPLITKLNITVSSGQCAVIVGENGRGKTTLLRALAREFPPSAGEILTHGTVAIAHQHMPAGDLSVGEICDEAIRDSKNALEELERAGALLETNTAHALDGYQQALDAAEVLDAWNAEHRLEKALRSFGAITDRSRALSELSIGQRYRVRLACLIGGDADILLLDEPTNHLDRGALNYLTEAITSHKGVVLVVSHDQALIKDVADFIIDIDSTPDGLPRIYHEGFDSYRRQRSALLETWRQDYAAAQTVQQQLQEDLEHARQRVNSSWKPPKGTGKHTRASRAPGVVQALKRAQDALDSKALDVPPAPAPLLLPTLKVRPDKPMVDFSDLFVPHRLRLPGSHSVVSGDKIVITGDNGAGKSTLIEVLSGVLTPASGSVANHARTGVLGQESLVGEVPSIARDHAVKWGLLSVEESRFALQEFSIGQRRRLDLAMSLAGNPELLLLDEPSNHLSMHLVSALTEWLDTTAAAVIMVTHDRQLLRDTAHWRHIELKS

SEQ ID NO: 357 - DNA, 879 bp, Corynebacterium glutamicum
  CDS (101)..(856): RXN02515
gtggctaagcacagttacttggccaagctgggcggcagaaaaaccggcccagctaatacttcagtttaaaattcgcttcaaccctgaaagattgtgacagatgagcactcttgaaatccgtaacctgcacgcacaggtcctgccgtccgatgagtccgctgagcctaaggaaatcctcaagggcgtcaacctcaccatcaactctggtgagatccacgccatcatgggccctaacggttccggcaagtccactcttgcttacacccttggtggacacccacgctacgaggtaaccgcaggcgaggtcctcctcgacggcgagaacatcctggagatggaagttgatgagcgtgcacgcgctggtctcttcctggccatgcagtatccaactgaaatccctggcgtttccgttgctaacttcctgcgttccgcagcgaccgcaatccgcggcgaggctcctaagcttcgcgagtgggttaaggaagtccgcaccgctcaggaagctctggcaattgaccctgagttctccaaccgctcagtcaacgaaggtttctccggtggcgagaagaagcgccacgaggttctgcagcttgatctgctgaagccaaagttcgcgatcatggatgagaccgactccggccttgacgtggatgcactgcgcattgtttccgagggcatcaactcctacaagcaggagaccgaaggtggcatcttgatgatcacccactacaagcgcatcctcaactacgttaagcctgacttcattcacgttttcgcgaatggccagattgtgaccaccggtggcgctgagcttgctgacaagctcgaggctgacggctacgaccagttcatcaagtaacatgtccgatttcctcaatg

SEQ ID NO: 358 - protein, 252 aa, Corynebacterium glutamicum
MSTLEIRNLHAQVLPSDESAEPKEILKGVNLTINSGEIHAIMGPNGSGKSTLAYTLGGHPRYEVTAGEVLLDGENILEMEVDERARAGLFLAMQYPTEIPGVSVANFLRSAATAIRGEAPKLREWVKEVRTAQEALAIDPEFSNRSVNEGFSGGEKKRHEVLQLDLLKPKFAIMDETDSGLDVDALRIVSEGINSYKQETEGGILMITHYKRILNYVKPDFIHVFANGQIVTTGGAELADKLEADGYDQFIK

SEQ ID NO: 359 - DNA, 1386 bp, Corynebacterium glutamicum
  CDS (101)..(1363): RXN00525
ccatcgtgtttattactcacaaccctgagcttgctgatgaatctgatcgggtggtcaccatggttgacgggcgcatcattgggtctgaggtgaaacactcatgagccttgcagaatcaattcttttggcgctcaccagcctgagaagcaacaagatgcgtgcattgttgacgctgttaggagtcatcattggtatcgcatcagtcatcggaattttgaccattggtaaagccctgcaggatcaaactttgaatagtttggaaagcttgggcgcgaatgatctgtcggcgcaggtggaggaacgccccgacgaagattcccccgaacccgatatgttcgctttttctggggctgcaaactctagtggcaatctgattccggaagaaacagttgatacgctgcgcgatcgtttcgcaggcagcatcacgggaatcagcgttggcggaatgggtacgcaaggcactctcatcggcgacaccgcagatcttaaatccgatctcctcggcgtcaacgaggattatatgtggatgaatggcgtcgaaatgaactacggccgcgccatcacgcaagacgatgttgccgctcagcgccccgttgcggtcatcgccccagacacctttaatacgcttttcgacgcaaaccccaacctcgctctggggtccgaagtagcttttgaactcaacggtcaagagacatttttgcgggttatcggtgtgtataaagaagccgcagcaggtggacttgtgggaagcaatccaaccgtccacacctacaccccatatacggtggccaatgacatcacccacacggaagatggattgaacacgttaagtatccgtgcagctcagggcgtagaccaggattcacttaagggttcactgcaaacctacttcgacgcgctgtacgccaacaatgactcgcaccacgttgccatgttggacttccgtaaacagatcgaagagttcaacaccattctcggcgcaatgagtttgggtatctcagccatcggcggaatttccttgcttgtcggtggcatcggagtgatgaacattatgttggtgtctgtcaccgagcgaacccgcgaaatcggtgtccgaaaagccctcggcgctcgtcgacgtgacattcgcctgcaattcgtcgttgaagccatgatcatttgtttcatcggtggcatcctcggcgtgcttttgggcggcattttgggattgatcatgtccagcgctattggctacatttccttgccaccactgagtggaatcgtgatcgccttggtattttccatggctatcggcctgtttttcggctactaccccgccaacaaggcagcaaagctcgatccaattgacgccttgcgttatgagtaaaagcctcgtttttaaggtag

SEQ ID NO: 360 - protein, 421 aa, Corynebacterium glutamicum
MSLAESILLALTSLRSNKMRALLTLLGVIIGIASVIGILTIGKALQDQTLNSLESLGANDLSAQVEERPDEDSPEPDMFAFSGAANSSGNLIPEETVDTLRDRFAGSITGISVGGMGTQGTLIGDTADLKSDLLGVNEDYMWMNGVEMNYGRAITQDDVAAQRPVAVIAPDTFNTLFDANPNLALGSEVAFELNGQETFLRVIGVYKEAAAGGLVGSNPTVHTYTPYTVANDITHTEDGLNTLSIRAAQGVDQDSLKGSLQTYFDALYANNDSHHVAMLDFRKQIEEFNTILGAMSLGISAIGGISLLVGGIGVMNIMLVSVTERTREIGVRKALGARRRDIRLQFVVEAMIICFIGGILGVLLGGILGLIMSSAIGYISLPPLSGIVIALVFSMAIGLFFGYYPANKAAKLDPIDALRYE

SEQ ID NO: 361 - DNA, 1815 bp, Corynebacterium glutamicum
  CDS (101)..(1792): RXN02096
cgcttcgacgacctcacccacagcgatatccgcaggaatctcatcgcggtttttgatgagccgttcttgtactcctcctccataccgcgagaacatctcgatgggtttggatgtcagtgatgagcagatcgaacacgcagccaggcttgcccaggctcatgattttatcgatcgccttccaaacaaatacgaggaagtcattggcgaacgcggcctgacgctttctggtggtcaacgccaacgcatcgccctcgcacgggctttcctggcgcatcccaaagtgttggtgcttgatgatgccacctctgccattgatgcctccactgaggaccgcattttccaggccttgcgcgaagaactgcacgatgtcaccattttgatcatcgcgcaccgccactccactttggagctcggcgatcgggttggtctggtcgaagatggacgggtaacagcactgggaccgttgagtgagatgcgtgatcacgctcgtttctcgcatctgatggctcttgatttccaggattctcacgatccggaattcaccctcgacaacggttcactacccagccaagagcaattgtggccggaggtctccacagaaaagcagtacaagattcttgcgcctgcccctggtcgaggccgtggcatgtccatgccagcaacccctgagctgctcgcccagattgaggcgctgccagcagcaacggaagaaacacgagttgatgccgggaggctacgcaccagtacctccggtttcaaattgctcagtttattcaagcaggtccgttggctcgtcgtcgcggtcatcgcgttgttgctggtgggcgtagccgccgatctagcatttccaacactgatgcgcgcagccatcgacaacggtgtgcaagcacaaagcacctccacgttgtggtggatcgccatcgcaggcagcgtagtagtccttctgtcctgggccgccgccgcgatcaacacgattatcacggcacgcaccggtgaacggctgctttacggcttgcgtctgcgctcatttgtgcatctattgcgcctgtccatgagctatttcgaacgcaccatgtccggccgcatcatgacgcgcatgaccaccgacatcgacaacctctcgtccttcctccaatcaggtctggcgcaaacagttgtctctgtgggcacgctcatcggtgtggtcaccatgctcgccatcaccgacgcacaactagcactcgttgcgctgtccgtggtgccgatcatcatcgtgctcactctcattttccgacgcatcagctccaggctgtacaccgcttcacgcgagcaagccagccaggtcaacgcggtattccacgagtccatcgccggtttacgcaccgcgcagatgcaccgcatggaagaccaagtctttgacaattatgcgggcgaagcagaggaattccgacgcctgcgtgtgaaatcccagacggccatcgccatctacttccccggccttggcgcgctctctgaaatcgcccaggcactcgtcctcggtttcggcgcactgcaagtaacgcgcggcgacatctccaccggcgtactcgtggcattcgtgctgtacatgggcctgatgttcggccccatccaacaactaagccaaatcttcgactcctaccaacaagccgccgtcggcttccgtcgcatcaccgaactgctcgcaacgcagcccagcgtccagatctgggcaccaacaggcacgctaggcaggctgccacgcagcctttattgcttgacgacgtcaccttcggctattcagacgatccgatcctagacaacgtcaccgtccagatc

SEQ ID NO: 362 - protein, 564 aa, Corynebacterium glutamicum
MGLDVSDEQIEHAARLAQAHDFIDRLPNKYEEVIGERGLTLSGGQRQRIALARAFLAHPKVLVLDDATSAIDASTEDRIFQALREELHDVTILIIAHRHSTLELGDRVGLVEDGRVTALGPLSEMRDHARFSHLMALDFQDSHDPEFTLDNGSLPSQEQLWPEVSTEKQYKILAPAPGRGRGMSMPATPELLAQIEALPAATEETRVDAGRLRTSTSGFKLLSLFKQVRWLVVAVIALLLVGVAADLAFPTLMRAAIDNGVQAQSTSTLWWIAIAGSVVVLLSWAAAAINTIITARTGERLLYGLRLRSFVHLLRLSMSYFERTMSGRIMTRMTTDIDNLSSFLQSGLAQTVVSVGTLIGVVTMLAITDAQLALVALSVVPIIIVLTLIFRRISSRLYTASREQASQVNAVFHESIAGLRTAQMHRMEDQVFDNYAGEAEEFRRLRVKSQTAIAIYFPGLGALSEIAQALVLGFGALQVTRGDISTGVLVAFVLYMGLMFGPIQQLSQIFDSYQQAAVGFRRITELLATQPSVQIWAPTGTLGRLPRSLYCLTTSPSAIQTIRS

SEQ ID NO: 363 - DNA, 1203 bp, Corynebacterium glutamicum
  CDS (101)..(1180): RXN00412
cttttgacgaacaccacgtcgcgtacgcttcctcggggcgttaaactatttgtcttccagcttttgtcccccgacttttgtacgaatcgaggacaccgtcgtgtcacacaccgcgtccacaccgacgccagaggaatactccgcgcagcaacccagcacccagggcactcgcgttgagttccgcggcataaccaaagtctttagcaacaataaatctgctaaaaccaccgcgcttgataatgtcactctcaccgtagaacccggtgaggtaatcggcatcatcggttactctggcgccggcaagtccactcttgtccgcctcatcaatggccttgactcccccacgagcggttcgttgctgctcaacggcaccgacatcgtcggaatgcccgagtctaagctgcgtaaactgcgcagtaatatcggcatgattttccagcagttcaacctgttccagtcgcgtactgcggctggaaatgtggagtacccgctggaagttgccaagatggacaaggcagctcgtaaagctcgcgtgcaagaaatgctcgagttcgtcggcctgggcgacaaaggcaaaaactaccccgagcagctgtcgggcggccagaagcagcgcgtcggcattgcccgtgcactggccaccaatccaacgcttttgcttgccgacgaagccacctccgctttggacccagaaaccacccatgaagttctggagctgctgcgcaaggtaaaccgcgaactgggcatcaccatcgttgtgatcacccacgaaatggaagttgtgcgttccatcgcagacaaggttgctgtgatggaatccggcaaagttgtggaatacggcagcgtctacgaggtgttctccaatccacaaacacaggttgctcaaaagttcgtggccaccgcgctgcgtaacaccccagaccaagtggaatcggaagatctgcttagccatgagggacgtctgttcaccattgatctgactgaaacgtccggcttctttgcagcaaccgctcgtgctgccgaacaaggtgcttttgtcaacatcgttcacggtggcgtgaccaccttgcaacgccaatcatttggcaaaatgactgttcgactcaccggcaacaccgctgcgattgaagagttctatcaaaccttgaccaagaccacgaccatcaaggagatcacccgatgaacgagatgatcctcgcagct

SEQ ID NO: 364 - protein, 360 aa, Corynebacterium glutamicum
VSHTASTPTPEEYSAQQPSTQGTRVEFRGITKVFSNNKSAKTTALDNVTLTVEPGEVIGIIGYSGAGKSTLVRLINGLDSPTSGSLLLNGTDIVGMPESKLRKLRSNIGMIFQQFNLFQSRTAAGNVEYPLEVAKMDKAARKARVQEMLEFVGLGDKGKNYPEQLSGGQKQRVGIARALATNPTLLLADEATSALDPETTHEVLELLRKVNRELGITIVVITHEMEVVRSIADKVAVMESGKVVEYGSVYEVFSNPQTQVAQKFVATALRNTPDQVESEDLLSHEGRLFTIDLTETSGFFAATARAAEQGAFVNIVHGGVTTLQRQSFGKMTVRLTGNTAAIEEFYQTLTKTTTIKEITR

SEQ ID NO: 365 - DNA, 798 bp, Corynebacterium glutamicum
  CDS (101)..(775): RXN00411
catttggcaaaatgactgttcgactcaccggcaacaccgctgcgattgaagagttctatcaaaccttgaccaagaccacgaccatcaaggagatcacccgatgaacgagatgatcctcgcagctgactggaaccggctaggacccaccttccaaacagccatcattgacaccctgttgatggtcatcatcaccatggtggtggctggcttactgggtcttgtcgtcggcctgctgctttacaccacccgcgctggtggaatcttgaagaacaaggtcatctacaccattttgaatgtgctggtgaactttgttcgacccatcccattcattattttgatcgccgccatcaagccactaacggtcgccgtcatgggcacctccatcggccgagatgccggcatcttcgtcatggttgtcgcagcgattttctctgtggctcgaatcgtggagcaaaacttggtctccattgatcctggtgtcatcgaggcagctcgctccatgggtgcgtccccgatgcgcatcatcgccaccgtgatcattccagaagcacttggaccattggttctgggttacaccttcctgttcatcgcgatcgtcgatatgtccgcaatggtcggctacatcggtggcggtggtcttggtgacttcgccattgtttacggctaccgcgccttcgacaacgaagttatgtacgttgccgtcctggttatcgtcatcatcgtgcaggcagcccagcttctgggcaattggctgtccaagaagatcatgcgccgctaaacctcttgcatagaaaaacc

SEQ ID NO: 366 - protein, 225 aa, Corynebacterium glutamicum
MNEMILAADWNRLGPTFQTAIIDTLLMVIITMVVAGLLGLVVGLLLYTTRAGGILKNKVIYTILNVLVNFVRPIPFIILIAAIKPLTVAVMGTSIGRDAGIFVMVVAAIFSVARIVEQNLVSIDPGVIEAARSMGASPMRIIATVIIPEALGPLVLGYTFLFIAIVDMSAMVGYIGGGGLGDFAIVYGYRAFDNEVMYVAVLVIVIIVQAAQLLGNWLSKKIMRR

SEQ ID NO: 367 - DNA, 852 bp, Corynebacterium glutamicum
  CDS (101)..(829): RXN02614
tcattgtatacgccaccctcggtctgctgtctgaagcgctgatcagagcttgggaacgtcacaccttccgctaccgaaacgcataagaaagttgctcgccatgactgccacattgtcactcaaacccgcagccactgtccgtggattgcgcaaatcatacggaactaaagaagtcctccaaggaatcgacctcaccatcaactgcggcgaagtaaccgcgctgatcggacgctcaggttcaggaaaatccaccatcctgcgcgtgttggcgggcctatctaaagagcattccggctctgtagaaatttccggaaacccggccgttgccttccaagagcctcgcctgttgccgtggaaaacggtgctcgataatgtgacctttggcctcaaccgcactgatatttcctggtcagaagcacaagaacgcgcctcggcactgcttgcagaagtcaaacttcccgactccgacgccgcctggcccctcacgctctccggcggccaagcccagcgcgtctcccttgcgcgagcgctcatctccgagccagagcttttgcttctcgacgaacccttcggcgccctcgatgctctgacaagactgacagcccaagacctgctgctcaaaaccgtgaacacccgaaacttgggagttctgctggtcacccatgatgtttccgaggccatcgccctggccgaccacgtccttcttcttgacgacggcgccatcacacacagtttgactgtagatatccccggcgatcgccgcacccacccctcctttgcctcctacaccgctcaactccttgagtggctcgaaatcaccacacctgcctagaaagaaatcatgaaatttaa

SEQ ID NO: 368 - protein, 243 aa, Corynebacterium glutamicum
MTATLSLKPAATVRGLRKSYGTKEVLQGIDLTINCGEVTALIGRSGSGKSTILRVLAGLSKEHSGSVEISGNPAVAFQEPRLLPWKTVLDNVTFGLNRTDISWSEAQERASALLAEVKLPDSDAAWPLTLSGGQAQRVSLARALISEPELLLLDEPFGALDALTRLTAQDLLLKTVNTRNLGVLLVTHDVSEAIALADHVLLLDDGAITHSLTVDIPGDRRTHPSFASYTAQLLEWLEITTPA

SEQ ID NO: 369 - DNA, 1080 bp, Corynebacterium glutamicum
  CDS (101)..(1057): RXN02613
agatatccccggcgatcgccgcacccacccctcctttgcctcctacaccgctcaactccttgagtggctcgaaatcaccacacctgcctagaaagaaatcatgaaatttaagaaaatcgccctcgttctcgccttcggtctaggccttgcatcctgctcatcagcttctggcgatcccgccaccaacgccgatggatccatcgatctgagcaaagtaacccttaacatcggtgatcaaatcgccggaacagaacaagtgctccaagcttcaggggagctagatgatgtcccttataaaatcgaatggtcatcatttacctctggaccaccccaaatcgaagcattaaacgcaggtcaaattgatttcgcgatcaccggaaacaccccaccgatcatcggcggccccaccaacaccaaagtggtctccgcctacaacaacgatgctttaggtgatgtcatcttggtcgccccggattcttcaataacctcggtggctgaccttgctggaaagaaagtggctgtcgcccgcggatccagcgcccacggacacctcatccaacaactagaaaaagcaggcgtgagcgttgacgacgtagaaatcaacctcctccaaccctccgacgccaaagccgctttccaaaacggccaggtagatgcgtgggcagtgtgggatccctacagctcacaggcggaactggaaggagctcaagttttggtcaggggagcgggactggtcagtgggcatggatttggtgtcgcaagtgatgaagcgctcgatgaccccgcaaaggaagccgccttggcagatttcctcgatcgcgtggccgactcttatgaatgggctgaagacaacaccgatgaatgggcgacgattttcagccaagaatccggctttgatccggaggcctctcaactgaacacccgcagcctgcgccatcaggtgccgctcgacgagtccgtcaacacctatcagaacgcgcttatcgacgctttcgtctccgcgggtctcgttgaggactttaatttcgaggacaccgtagacacccgatttgagggctaagtatgtctgagtatggcaaa

SEQ ID NO: 370 - protein, 319 aa, Corynebacterium glutamicum
MKFKKIALVLAFGLGLASCSSASGDPATNADGSIDLSKVTLNIGDQIAGTEQVLQASGELDDVPYKIEWSSFTSGPPQIEALNAGQIDFAITGNTPPIIGGPTNTKVVSAYNNDALGDVILVAPDSSITSVADLAGKKVAVARGSSAHGHLIQQLEKAGVSVDDVEINLLQPSDAKAAFQNGQVDAWAVWDPYSSQAELEGAQVLVRGAGLVSGHGFGVASDEALDDPAKEAALADFLDRVADSYEWAEDNTDEWATIFSQESGFDPEASQLNTRSLRHQVPLDESVNTYQNALIDAFVSAGLVEDFNFEDTVDTRFEG

SEQ ID NO: 371 - DNA, 1698 bp, Corynebacterium glutamicum
  CDS (101)..(1675): RXN00368
ttcttccaaaacgcaatgaactagttttcctatgcagttatctccttcaaatacgtcgacgcagcgctttcacatctctgcgttgacgtctttgtctttcatgcgtctgggtgtgtggctgattgtcgcggggttgtttatcactccgttggcgctggtggtgggcttggcgttgggaggcaatcagtttcctgctctgtgggattccggattgggcaaagccctatggaattccgcctatacaacagtgctttctgcggtgggcgcgaccattatcggcacgatcatggctctcacgctggaccgaactgatgttttcgggcgcaccgcgttgcggttatttttgttatccccgctgttgatccctccgtttattggggctattgcgtggttgcagctgttcgggaagaaccagggcatcaaccggtttttcggcacggaagtgtgggatatttacggcgctgatggtgtgacatttttgttgattgtgcactcctatcccactgtgtacatcattgtttcggcagctctgaggcaacttcctagtgatttggagcaagctgcacggatcgcgggggcggatacttttacggtgttgcgcaccatcacactcccactgctcaaacctgcattgttgtcggcgtttactcttaccacagtggcgaacctcgccgactttggcattccagctctgttgggatcgccagcgcgttttgaaaccttagccaccatgatttatcgcttcatggaatccggcaccgtgagcaatccattgcaggtggtatccaccattggcatcgtgttgttgttcctgggaatcgcagcagtaaccgcggattatctggtgtctttgtacgcggcatcaaagttgcaagacgcaggaacaccgcatcgctttactctcaacaaatcacgaatcccagtcagcgtgatcacgtggatcatcgcgttgatcatcaccgccgccccgctgctgggtctggcatacagagcattactgcctgccccaggtgtgccgttcaacctagacaacatcacgctcaacaactttgaagcagcactgagcaatccacgagtaatcgaaggattcagcaactccctcatgttatccctgggtgcagccctaatctgtggggtgctgggatggctgatcggagtgctcatcacccgaacccagcatttcgccaacgtaccgttgacactcactgtgctgcttcccaccgcactgccgggcatgatcatcggcgtcggctggctcattttgggcagatacaccggaatttacaacacaccttgggtgattttgggtgcatatgtgtgtgcttttaccgcgctggttgtccaagctgtacgcggaccactcagtcaagcacccgaagcaatcgaagaagccgcacgaatcagcggcgcaggcagattacgatccatcatggacaccaccggagcgatggcaattcccgcagctttcgccggcgcagtgctggttgcggtaactgcggttcgagagttaaccgtgtccattttgctcatcgcgccgggcaccaccaccctgggtgtgcaggtgttcaatttgcagcaggcgggaaattacaatcaggcatcggcgttgtcgttgatgtttgcgattatcggtatcgtggcgctcgcgttgacggtgcgcagccagaaggagttttaggtgtcatcgatcaaattgcg

SEQ ID NO: 372 - protein, 525 aa, Corynebacterium glutamicum
MRLGVWLIVAGLFITPLALVVGLALGGNQFPALWDSGLGKALWNSAYTTVLSAVGATIIGTIMALTLDRTDVFGRTALRLFLLSPLLIPPFIGAIAWLQLFGKNQGINRFFGTEVWDIYGADGVTFLLIVHSYPTVYIIVSAALRQLPSDLEQAARIAGADTFTVLRTITLPLLKPALLSAFTLTTVANLADFGIPALLGSPARFETLATMIYRFMESGTVSNPLQVVSTIGIVLLFLGIAAVTADYLVSLYAASKLQDAGTPHRFTLNKSRIPVSVITWIIALIITAAPLLGLAYRALLPAPGVPFNLDNITLNNFEAALSNPRVIEGFSNSLMLSLGAALICGVLGWLIGVLITRTQHFANVPLTLTVLLPTALPGMIIGVGWLILGRYTGIYNTPWVILGAYVCAFTALVVQAVRGPLSQAPEAIEEAARISGAGRLRSIMDTTGAMAIPAAFAGAVLVAVTAVRELTVSILLIAPGTTTLGVQVFNLQQAGNYNQASALSLMFAIIGIVALALTVRSQKEF

SEQ ID NO: 373 - DNA, 602 bp, Corynebacterium glutamicum
  CDS (1)..(579): FRXA00368
tccctcatgttatccctgggtgcagccctaatctgtggggtgctgggatggctgatcggagtgctcatcacccgaacccagcatttcgccaacgtaccgttgacactcactgtgctgcttcccaccgcactgccgggcatgatcatcggcgtcggctggctcattttgggcagatacaccggaatttacaacacaccttgggtgattttgggtgcatatgtgtgtgcttttaccgcgctggttgtccaagctgtacgcggaccactcagtcaagcacccgaagcaatcgaagaagccgcacgaatcagcggcgcaggcagattacgatccatcatggacaccaccggagcgatggcaattcccgcagctttcgccggcgcagtgctggttgcggtaactgcggttcgagagttaaccgtgtccattttgctcatcgcgccgggcaccaccaccctgggtgtgcaggtgttcaatttgcagcaggcgggaaattacaatcaggcatcggcgttgtcgttgatgtttgcgattatcggtatcgtggcgctcgcgttgacggtgcgcagccagaaggagttttaggtgtcatcgatcaaattgcg

SEQ ID NO: 374 - protein, 193 aa, Corynebacterium glutamicum
SLMLSLGAALICGVLGWLIGVLITRTQHFANVPLTLTVLLPTALPGMIIGVGWLILGRYTGIYNTPWVILGAYVCAFTALVVQAVRGPLSQAPEAIEEAARISGAGRLRSIMDTTGAMAIPAAFAGAVLVAVTAVRELTVSILLIAPGTTTLGVQVFNLQQAGNYNQASALSLMFAIIGIVALALTVRSQKEF

SEQ ID NO: 375 - DNA, 798 bp, Corynebacterium glutamicum
  CDS (1)..(798): FRXA00370
ggcaaagccctatggaattccgcctatacaacagtgctttctgcggtgggcgcgaccattatcggcacgatcatggctctcacgctggaccgaactgatgttttcgggcgcaccgcgttgcggttatttttgttatccccgctgttgatccctccgtttattggggctattgcgtggttgcagctgttcgggaagaaccagggcatcaaccggtttttcggcacggaagtgtgggatatttacggcgctgatggtgtgacatttttgttgattgtgcactcctatcccactgtgtacatcattgtttcggcagctctgaggcaacttcctagtgatttggagcaagctgcacggatcgcgggggcggatacttttacggtgttgcgcaccatcacactcccactgctcaaacctgcattgttgtcggcgtttactcttaccacagtggcgaacctcgccgactttggcattccagctctgttgggatcgccagcgcgttttgaaaccttagccaccatgatttatcgcttcatggaatccggcaccgtgagcaatccattgcaggtggtatccaccattggcatcgtgttgttgttcctgggaatcgcagcagtaaccgcggattatctggtgtctttgtacgcggcatcaaagttgcaagacgcaggaacaccgcatcgctttactctcaacaaatcacgaatcccagtcagcgtgatcacgtggatcatcgcgttgatcatcaccgccgccccgctgctgggtctggcatacagagcattactgcctgccccaggt

SEQ ID NO: 376 - protein, 266 aa, Corynebacterium glutamicum
GKALWNSAYTTVLSAVGATIIGTIMALTLDRTDVFGRTALRLFLLSPLLIPPFIGAIAWLQLFGKNQGINRFFGTEVWDIYGADGVTFLLIVHSYPTVYIIVSAALRQLPSDLEQAARIAGADTFTVLRTITLPLLKPALLSAFTLTTVANLADFGIPALLGSPARFETLATMIYRFMESGTVSNPLQVVSTIGIVLLFLGIAAVTADYLVSLYAASKLQDAGTPHRFTLNKSRIPVSVITWIIALIITAAPLLGLAYRALLPAPG

SEQ ID NO: 377 - DNA, 749 bp, Corynebacterium glutamicum
  CDS (1)..(726): RXN01285
ctcaacgtcaccatccccgacaacaccttcaccgccatcatcggccccaacggctgcggcaaatccaccctgctccgcggtttctcccgcgtgctcaatccgcagcacggcaaagtgcttctcgacggtcggcaactcgattcattcaagcctaaagagatcgcccgagaactaggcctgctgccacagacctccatcgccccagaaggcatccgggtttacgatctcatcgcgcgcgggcgcgctccctaccaaagcctcatacaacaatggcgcacctccgacgaagacgccgtcgcgcaagcgctcgcctccacgaatctcaccgaacttgcagctcgcctcgtcgatgaactctccggtggccagcgccaacgagtgtgggtggccatgttgctcgcccagcaaacaccgatcatgcttctcgacgagcccaccaccttcctcgacatcgcccaccaatacgaactcttggaattgctgcgcgcattcaacgaggccgggaaaactgtggtcactgtgcttcacgatctcaaccaagccgcccgctacgccgaccacctcatcgtgatgaaagatgggcacgtacatgccacgggcacaccggaggaagtcttaactgccgagatggttcaaggagtttttggcctgccctgcatcatctccccagaccccgtcacaggaacccccaccgtcgttcccctcagtcggtctcgcgcaggagcttaagtagctacccctccaacgga

SEQ ID NO: 378 - protein, 242 aa, Corynebacterium glutamicum
LNVTIPDNTFTAIIGPNGCGKSTLLRGFSRVLNPQHGKVLLDGRQLDSFKPKEIARELGLLPQTSIAPEGIRVYDLIARGRAPYQSLIQQWRTSDEDAVAQALASTNLTELAARLVDELSGGQRQRVWVAMLLAQQTPIMLLDEPTTFLDIAHQYELLELLRAFNEAGKTVVTVLHDLNQAARYADHLIVMKDGHVHATGTPEEVLTAEMVQGVFGLPCIISPDPVTGTPTVVPLSRSRAGA

SEQ ID NO: 379 - DNA, 1149 bp, Corynebacterium glutamicum
  CDS (101)..(1126): RXN00523
tggtgactcgtccgagtgaaattgccgtgggcatcatcatgccgatcattggtgcgccactgtttatttggattattcgtcgtcagaaagtcaaagagctatgagccttagccatcaactcaagcgccagcgcgcatcgcgcaactcccgcaggtggctgattgttgcggcattgggcgtcgtcacgcttggtatttttgctttttctttgatgtggggcgaggtgttttatggccctgctcaggtgctgaaagtgttgtctggacagcaggttcccggcgcgagttattccgttggcgtgttgcgtttgccgcgcgcggtgatgggtttgactgcgggtttggcgtttggcgcggcgggcgtgatttttcagacggtgttgcgtaatcagttggcgtcgccggatattatcggcatttcttctggcgcgtcggcggcgggcgtaatttgcattgtgtttttcgggatgtcgcagtctgcagtgtcggcgatttctttgtgtgcgtccttggctgtggcgttgttgatttatctggtggcgtatcgcggtggtttttcggccacgcgtctgattcttaccggcattggtattgctgcgatgctgaattcattagtgtcgtattcgctgtccaaggctgattcttgggatctgccgaccgcgacgcgctggcttaccggctcgctcaatggtgcgacgtgggatcgtgcgatgccgctgattgtcaccactgtggtactcattccgctgctggtggctaatgcgcgcaatgtggatcttatgcgtttgggcaatgattccgcggtgggtttgggcgttgctactaatcgcacgcgcgtcattgcgattattgccgctgttgcgctcatcgccgttgctaccgctgcatgcggcccgatcgcattcgtggcgtttgtgtctggccccattgccgcgcgcattttaggctccggcggatcgctcatcatcccctccgcactcatcggcgggttgatcgtgctcatcgccgacctaattggccaatacttcctcggcacccgctaccccgtcggagttgtcaccggcgcattcggcgccccattccttatctatttactcattcgttccaaccgcgcgggagtaaccctgtgaccaccaaccatcaactatcc

SEQ ID NO: 380 - protein, 342 aa, Corynebacterium glutamicum
MSLSHQLKRQRASRNSRRWLIVAALGVVTLGIFAFSLMWGEVFYGPAQVLKVLSGQQVPGASYSVGVLRLPRAVMGLTAGLAFGAAGVIFQTVLRNQLASPDIIGISSGASAAGVICIVFFGMSQSAVSAISLCASLAVALLIYLVAYRGGFSATRLILTGIGIAAMLNSLVSYSLSKADSWDLPTATRWLTGSLNGATWDRAMPLIVTTVVLIPLLVANARNVDLMRLGNDSAVGLGVATNRTRVIAIIAAVALIAVATAACGPIAFVAFVSGPIAARILGSGGSLIIPSALIGGLIVLIADLIGQYFLGTRYPVGVVTGAFGAPFLIYLLIRSNRAGVTL

SEQ ID NO: 381 - DNA, 621 bp, Corynebacterium glutamicum
  CDS (101)..(598): RXN01142
ctccccatccaccggcacagtcagcgcaggcaacgaagaaattaaaggaccaggacctgaccgaggcatggttttccaagaccacgccctcctgccctgattgaccgcacgcggcaacatcgacttcgggctccgctccgcgcgcccctccttgagcaaaaccgaacgcgccgacatcacccgcacccacctcgaacaagtaggcctcaccgacgccgccgaacggcgccccgcccgcctctccggcggcatgcaacagcgagtcggcatcgcacgcgccttcgccatcgacccaccaatcatgcttctcgacgaacccttcggcgccctcgacgccctcacccgccgcgaactccagctccaactactcaacatttgggaagcctcccgccgcaccgtcgtcatggtcacccacgacgtcgacgaggccatcctgctctccgaccgagttctcgtgatgtccaagagccccgaagccaccatcatcaccgatattccagtgaatcttccccgccccagacacgagctgagtgaagacgcttctgttgaagccgagaccacagccctgcgtaagcggatgctgcatctgctggagcactagtttctaacacgtcttttaaa

SEQ ID NO: 382 - protein, 166 aa, Corynebacterium glutamicum
LTARGNIDFGLRSARPSLSKTERADITRTHLEQVGLTDAAERRPARLSGGMQQRVGIARAFAIDPPIMLLDEPFGALDALTRRELQLQLLNIWEASRRTVVMVTHDVDEAILLSDRVLVMSKSPEATIITDIPVNLPRPRHELSEDASVEAETTALRKRMLHLLEH

SEQ ID NO: 383 - DNA, 948 bp, Corynebacterium glutamicum
  CDS (101)..(925): RXN01141
aaagaacactcggtatggcacctgatttaaggatgctgcaatcgtgacacatatcctcttcgacagcaggcgttttctgcaactgggcgcttttgcgtccttgagcaccgcattggccggagcggcccgctacgtgacgtcgacaagcaataatgaacctgcggataacactcccctgaccattggctacgtgcctattgcgggctcggcgccgattgctatcgcagatgcgctagggctgtttaagaaacacggcgtgaatgtcacgttgaagaagtactcaggctggtccgacctgtggaccgcctatgcaacagagcagcttgatgttgcgcacatgctgtcgccgatgactgtggcgattaatgctggagtgaccaacgcgtcgcgcccgacggagctgtcgtttacccagaacaccaatgggcaagcaattaccttggcgtcaaagcactatggttccgtcaattcagcggcggatcttaaaggcatggtgctgggaattccttttgaatattcagtccatgcgctgctcctgcgcgattatctcgtctcaaacgcagttgatcccatcgccgatcttgagcttcgcctgctccgacctgccgatatggtcgcacaattgacagttgagggcatcgatggattcattgggcctgggccgtttaatgaacgcgccatcagcaatggctccggccggatttggctgctgaccaaacaactgtgggacaaacatccatgctgcgccgtggcgatggccaaagagtggaaagctgaacaccccacggcggctcagggtgtgcttaatgcgctggaggaagcctccgcaattttgagcaatccggcacaatttgattcctcggcacgcacgctgtcgcaggaaaaatacctcaaccagcctgccacgttgctggatggaccgtcgtaatcatcggcatcaccggctta

SEQ ID NO: 384 - protein, 275 aa, Corynebacterium glutamicum
LSTALAGAARYVTSTSNNEPADNTPLTIGYVPIAGSAPIAIADALGLFKKHGVNVTLKKYSGWSDLWTAYATEQLDVAHMLSPMTVAINAGVTNASRPTELSFTQNTNGQAITLASKHYGSVNSAADLKGMVLGIPFEYSVHALLLRDYLVSNAVDPIADLELRLLRPADMVAQLTVEGIDGFIGPGPFNERAISNGSGRIWLLTKQLWDKHPCCAVAMAKEWKAEHPTAAQGVLNALEEASAILSNPAQFDSSARTLSQEKYLNQPATLLDGPS

SEQ ID NO: 385 - DNA, 927 bp, Corynebacterium glutamicum
  CDS (101)..(904): RXN01002
gactgctgataccgcacaggatgaaatcactcgttacggcgagatcctgaagaagttctccaactaatttccctgtttccaatactcaaggtgtgcgcatatgaattctgatgcttcggctaccaccaactcctgggctatcaacttcgaccatgtgtcggtgacgtatcccaatgggacgaaagccctcgatgatgtttccctcaccatcaatcccggtgagatggttgccatcgtgggtctgtcaggatcgggtaaatccacgctgattcgcacgatcaacggtcttgtccgcgctacggaaggcaccgtgacggtggggccgcatcagatcaacaccttgaaggggaaagcactgcgtgatgcccgtgggcagatcggcatgattttccaggggttcaacctgtcggaacgcagcagtgtgttccagaatgttttggtgggccgcttcgcgcacacagcgtggtggcgtaacctcctcgggtttcccacggagcacgacaagcagattgcttttcacgcgttggagtccgtgggcattttgcacaaagtgtggacccgagctggtgctttgtcgggtggacagaaacagcgcgttgctattgcgcgcgccttatcgcaagatccgtctgtcatgctggcagatgagcctgtggcaagccttgatccgccaaccgcgcattccgtgatgcgcgatctagaaaacatcaacaacgtggaaggcctcaccgtgttggtgaacttgcacttgattgatttggctcgtcaatacaccacaaggcttgtgggtttgcgtgccggcaagctggtctatgacggtcctatctctgaggccaccgataaagactttgaagctatctatggtcgccccatccaggctaaagacctgctaggtgatcgcgcatgaccacgccttcttctacactt

SEQ ID NO: 386 - protein, 268 aa, Corynebacterium glutamicum
MNSDASATTNSWAINFDHVSVTYPNGTKALDDVSLTINPGEMVAIVGLSGSGKSTLIRTINGLVRATEGTVTVGPHQINTLKGKALRDARGQIGMIFQGFNLSERSSVFQNVLVGRFAHTAWWRNLLGFPTEHDKQIAFHALESVGILHKVWTRAGALSGGQKQRVAIARALSQDPSVMLADEPVASLDPPTAHSVMRDLENINNVEGLTVLVNLHLIDLARQYTTRLVGLRAGKLVYDGPISEATDKDFEAIYGRPIQAKDLLGDRA

SEQ ID NO: 387 - DNA, 969 bp, Corynebacterium glutamicum
  CDS (101)..(946): RXN01000
ctttctatgcctacgcggatgtttccgtgatcattctggaaatcctcatcgtggtgattgtcattgaagtaatctccaacgcacttcgaaagaggctggtatgagcaccttaacctctcaccgcacagtaccggcccccagctctcccccggcgcgccccaacaaactggcgcgcaatatcgttgcaattgtcgctgcgctgattgtccttatagctaccggcacgctcaagatcgagtggaatgagcttccgcagatgcccgcgcaggtgtggcattacttagagctgatgtttagcgatcccgattggtcgaagtttggccgcgccgtccaggaaatgtggcgttccatcgccatggcgtggttgggtgccattttatgcgtggtggtctctgtccctctgggaatgttggctgcccgcggggtgggaccttattggctgcgtaccgttttacggttcgtgttcgcggtgattcgtgcgttccccgaagtggttatcgcaattattttgctaactgtcaccggcctaactccttttactggtgcgctcgcattgggtatctccggtattggacaacaggcaaagtggacctatgaagccattgagtccactcccaccggcccgtcagaggcagtgcgtgcagcgggtggaactacgccggaggttctgcggtgggcgttgtggccacaggttgcgccatccattgcatcttttgccctgtaccgctttgagatcaacatccgtacctctgcggtattgggcatcgttggtgcaggtggtatcggtagtatgcttgccaattacaccaactacaggcagtgggacaccgtgggcatgctgctcatcgtcgtggttgtcgcaacgatgatcgtcgatctcatctccggcaccatccgccgccgcatcatgaagggggctagtgaccgtgtcgtggcaccaagcaactgacgctccaccaagcatccgca

SEQ ID NO: 388 - protein, 282 aa, Corynebacterium glutamicum
MSTLTSHRTVPAPSSPPARPNKLARNIVAIVAALIVLIATGTLKIEWNELPQMPAQVWHYLELMFSDPDWSKFGRAVQEMWRSIAMAWLGAILCVVVSVPLGMLAARGVGPYWLRTVLRFVFAVIRAFPEVVIAIILLTVTGLTPFTGALALGISGIGQQAKWTYEAIESTPTGPSEAVRAAGGTTPEVLRWALWPQVAPSIASFALYRFEINIRTSAVLGIVGAGGIGSMLANYTNYRQWDTVGMLLIVVVVATMIVDLISGTIRRRIMKGASDRVVAPSN

SEQ ID NO: 389 - DNA, 1173 bp, Corynebacterium glutamicum
  CDS (101)..(1150): RXN01732
gattctatcgctgatctccctctccttgcctgggtttgttcccgggtctcctcttcttaactttcttgtctcatgtcgctgaaaggtttttaaagatctcatgttcaagctctctaagccatccaagtccatgcgtgttgctgtttctacgcttgcgatctctacccttgctctagttggttgttcctcttccgatgagtcttcttcctcatcatctgcgtcttcttcttcggatgctgcaagccagtggcctgagtccattactttgtctcttgttccttctactgagggtgaggatttggctgaagcgttggctcctttgactgattacctgtctgagaaccttggtattgaggtcaatggtgtggtggcgtctgattacgctgcaaccgttgaggctttgggtgctgatcaggctcaggtgatcatcactgatgcgggttccctgtataacgcgattgagcagtacgatgcgcagctgattctgcgtgatgtgcgtttcggtgccacctcgtactctgctgtggcgtacaccaacaatcctgataagtactgcgacgatgccccagtggctgcgtcttatgctgcgtccgatgtagacatgctttactgcaacggtattgaaactgagggccaggctgctaccggtgagggcccagcagctcttgatgcgctggaaaagatcgagtccggtgacaaggtagcgctgcaggctgcaacctctcctgcgggttaccagtaccctatcgtcgctatgcaggatctgggcatggataccgattccgcttttgttcaggttccagtagagggcaacaacaacgctgtgctgtctgtcctgaacggtgacgcggaagtgtccttcggtttctgggatgcgcgttccaccgtgctgtctgaggctcctaacgcagctgaggatgtcgtagcgtttgcctacaccgagatgatccctaacggtggcgtcgcagcgtccaagtcccttccatccgacctggtggaaaagctcaccgagttgatggatgattacgcagattcctccgaggaagccaaggatgtcatgttcgacatggttggtctatctgactggactgctgataccgcacaggatgaaatcactcgttacggcgagatcctgaagaagttctccaactaatttccctgtttccaatactc

SEQ ID NO: 390 - protein, 350 aa, Corynebacterium glutamicum
MFKLSKPSKSMRVAVSTLAISTLALVGCSSSDESSSSSSASSSSDAASQWPESITLSLVPSTEGEDLAEALAPLTDYLSENLGIEVNGVVASDYAATVEALGADQAQVIITDAGSLYNAIEQYDAQLILRDVRFGATSYSAVAYTNNPDKYCDDAPVAASYAASDVDMLYCNGIETEGQAATGEGPAALDALEKIESGDKVALQAATSPAGYQYPIVAMQDLGMDTDSAFVQVPVEGNNNAVLSVLNGDAEVSFGFWDARSTVLSEAPNAAEDVVAFAYTEMIPNGGVAASKSLPSDLVEKLTELMDDYADSSEEAKDVMFDMVGLSDWTADTAQDEITRYGEILKKFSN

SEQ ID NO: 391 - DNA, 903 bp, Corynebacterium glutamicum
  CDS (101)..(880): RXN03080
cttgcaaacaggcgtggtggtggcgttcattggctcaccaattttcctttatttactgctcagcatgcgcaagcgacgcggattggggctgtaaaaactcatgcctcaattagttgaaattcgtgatctcaacgttgaattcccctctcgccatgcagtgaaaaacgtgtctttttctgcacctgctggaaaagtcaccgcactgattggcccaaatggtgctggtaaaagtactgccctttcggcgattgcaggattggttgaatccaccggcgaggtaatggttggtgggagtggggttgcgtcgaaaagcgctaaagcccgagcccgcctgctctcactcgtgccgcaaaacaccgagttgcgcattggttttagtgcacgcgacgttgtcgcgatgggccgctacccgcatcgtggccgcttcgccgtggagaccgacgcagatcgacgcgccaccgatgacgccctgcgcgccatcaacgcgctcgacatcgccgagcagcccgtcaacgaattatcgggcggccagcagcagctcatccacatcggccgagcgctcgcccaagacaccgccgtcgtgcttctcgacgagcccgtctccgcccttgatctacggcaccaagttgaagtccttcaactcctgcgcgcccgagctaattccggcaccaccgtgatcgtcgtccttcacgatctcaaccacgttgcccgttggtgcgaccatgcagtgttgatggccgacggcgaagttgtctcccaaggtgacatccgcgaggtgctcgaacctgccacactgtccaccgtgtacggactgcccattgcggtgcgcgatgatcccgaaaccagctcacttcgcgtgatcccgcatccaaatcccttttgattgaaagtttgacttaaaaa

SEQ ID NO: 392 - protein, 260 aa, Corynebacterium glutamicum
MPQLVEIRDLNVEFPSRHAVKNVSFSAPAGKVTALIGPNGAGKSTALSAIAGLVESTGEVMVGGSGVASKSAKARARLLSLVPQNTELRIGFSARDVVAMGRYPHRGRFAVETDADRRATDDALRAINALDIAEQPVNELSGGQQQLIHIGRALAQDTAVVLLDEPVSALDLRHQVEVLQLLRARANSGTTVIVVLHDLNHVARWCDHAVLMADGEVVSQGDIREVLEPATLSTVYGLPIAVRDDPETSSLRVIPHPNPF

SEQ ID NO: 393 - DNA, 582 bp, Corynebacterium glutamicum
  CDS (101)..(559): RXN03081
acggactgcccattgcggtgcgcgatgatcccgaaaccagctcacttcgcgtgatcccgcatccaaatcccttttgattgaaagtttgacttaaaaacccatgaaaaaatcactcatcgccattgttgccagtgcgctcgtgttaagcggctgcacctctgattcttctgactcttccggcacttccggaactgtggaaaccacttcgattacaaccagcgttgccgcagctgacggcgcattcccacgcaccgtcacactcgacgattcctccatcaccttagaatccaaaccagagcgcatcgccgtactcaccccagaggcagcatccttggttctccccatcacaggcgccgaccgcgtcgtgatgaccgccgaaatggacaccgctgacgaagaaaccgcagctctggcctcccaagtggaataccaagtcaaaaacggtggcaggctcgaccccgaacaagttgtcgccggcgacccagatttggtgatcgtcagtgcgcgtttcgataccgaacaaggcaccatcgacattttggaaggcctcaacgtcccgtagttaacttcgattcagacgct

SEQ ID NO: 394 - protein, 153 aa, Corynebacterium glutamicum
MKKSLIAIVASALVLSGCTSDSSDSSGTSGTVETTSITTSVAAADGAFPRTVTLDDSSITLESKPERIAVLTPEAASLVLPITGADRVVMTAEMDTADEETAALASQVEYQVKNGGRLDPEQVVAGDPDLVIVSARFDTEQGTIDILEGLNVP

SEQ ID NO: 395 - DNA, 444 bp, Corynebacterium glutamicum
  CDS (101)..(421): RXN03082
cagaagcaatcgcagaaatcgatgcaaaccgcattcgacattcgacaagcctgccacctcccccactgtgctcactttgatgcaacgcggaccacgccaaatggtcatgccagaatctgccatgctcaccggcctgatccgcgaagccggcggcactccagtggtagattctctcggcgcggtaggcaccatcactgcagacccagaacaagttgttgcgatggcacctgagatcatcatcattcaggacttccaaggtaaaggccgagagaacttcgctaatttcctctccaacccagcgctagccaacgttcccgccattgaaaacgacaagattttctacgccgacactgtcaccactggagttactgcaggtaccgatatcaccactggtctgcagcaagtggcagaaatgctgagctagttttgagatgttgaaactag

SEQ ID NO: 396 - protein, 107 aa, Corynebacterium glutamicum
MVMPESAMLTGLIREAGGTPVVDSLGAVGTITADPEQVVAMAPEIIIIQDFQGKGRENFANFLSNPALANVPAIENDKIFYADTVTTGVTAGTDITTGLQQVAEMLS

SEQ ID NO: 397 - DNA, 1479 bp, Corynebacterium glutamicum
  CDS (101)..(1456): RXA02261
gaaatctatagaacgataggtaaaaactggactaggtttatctatagcggaatagaaaatactccgctcgacagcatcacttagctgaaaggcctttaacatggacccctcagatctagcctggattctcgcagcttttgcgttggtaagcctgatgttccccggattgtccctgctctacggcggcatgctgggtgggcaacacgttcttaacacgttcatgatggttatgagctcacttggaatcatcagccttgtgtacatcatttatggacacggacttgtcttaggaaactccatcggtgggtggggaattatcggaaatccccttgaatacttcggcttccgcaacattatggaagatgacggcaccggagacctcatgtgggccggcttctacattctgttcgctgcaatctcactcgcacttgtttcatctggtgcagcggggcgcatgcgctttggagcgtggctggtcttcggtgtcctgtggttcacctttgtgtacgcgccactggcacactgggttttcgctatcgatgatcctgagtccggctacgtgggtggctggatgaaaaatgtgcttgagttccacgactttgctggtggaacggcagtgcacatgaatgcgggtgcgtctggactcgcgctggcaatagtgctgggacgccgccactccatggctgtgcgtccacacaaccttccactgattttgattggtgcaggactgatcgttgcgggctggttcggattcaatggtggtaccgcaggtggtgccaacttcctcgcaagctacgtggtcgttacctctctcattgctgcagctggcggaatgatgggcttcatgctcgttgaacgtgtgttcagcggaaaacccactttctttggctcggcaaccggcacaatcgcaggccttgtggctatcaccccggccgcggatgcagtgagcccgctcggagcattcgccgtcggagcgctcggcgcagttgtctccttctgggcaattagctggaagaagggacaccgagtcgatgattccttcgatgtgttcgcagtccacggaatggccggcattgcaggtgcactgtttgtcatgctctttggcgatccactagcaccagcgggagtttccggagtcttcttcggtggcgaactctccctgctgtggagggaaccactggccatcatcgtgacccttacatacgcattcggcgtgacctggttgattgccacgatcttgaacaagttcatgactctgcgcatcacctccgaagccgaatatgaaggcattgaccgcgcagaacacgcagaatctgcctaccacctcaattccaacggaattgggatggcaacccgcaccaatttcggacctgaaatccccgaggaaaccgtgcccgacgccgtgcaggtgggcgtcgataagcaaaaaatcgctgatactcgaaaggcctcaaaatgaccgcaacctacaccactgaa

SEQ ID NO: 398 - protein, 452 aa, Corynebacterium glutamicum
MDPSDLAWILAAFALVSLMFPGLSLLYGGMLGGQHVLNTFMMVMSSLGIISLVYIIYGHGLVLGNSIGGWGIIGNPLEYFGFRNIMEDDGTGDLMWAGFYILFAAISLALVSSGAAGRMRFGAWLVFGVLWFTFVYAPLAHWVFAIDDPESGYVGGWMKNVLEFHDFAGGTAVHMNAGASGLALAIVLGRRHSMAVRPHNLPLILIGAGLIVAGWFGFNGGTAGGANFLASYVVVTSLIAAAGGMMGFMLVERVFSGKPTFFGSATGTIAGLVAITPAADAVSPLGAFAVGALGAVVSFWAISWKKGHRVDDSFDVFAVHGMAGIAGALFVMLFGDPLAPAGVSGVFFGGELSLLWREPLAIIVTLTYAFGVTWLIATILNKFMTLRITSEAEYEGIDRAEHAESAYHLNSNGIGMATRTNFGPEIPEETVPDAVQVGVDKQKIADTRKASK

SEQ ID NO: 399 - DNA, 1111 bp, Corynebacterium glutamicum
  CDS (101)..(1111): RXA02020
ttggtcaatcaagcgtgaatccggcttccatgagccagttgcccgcctcaaagcttgacccattttcataaccagtgccatgtgggtttacggttgatacatggctaaatctaatgaagggctgggaaccggacttcggacccgccacctcacaatgatgggactcggctccgcaattggtgccggactgttcctcggcaccggcgttggtatccgcgcagccggccccgcagtgctcctggcgtacatcatcgccggagccatcgttgtgcttgttatgcaaatgctcggcgagatggctgctgcccgtcccgcctccggatcgttttcacgttacggcgaggatgctttcggccactgggctggtttctccctcggttggttgtactggttcatgctgattatggtgatgggcgccgaaatgactggcgctgctgccatcatgggtgcatggttcggcgtcgaaccgtggattccttcgcttgtctgcgtggtcttcttcgctgtggtgaacctcgtcgcggttcgcggtttcggtgaattcgagtactggttcgcattcattaaggtcgcggtgatcatcgctttcctcatcattggtattgctcttattttcggatggcttcccggatccacctttgttggaacctcaaacttcatcggtgatcacggattcatgcccaatggtatttctggtgttgctgctggtttgctcgcggtggcttttgcctttggtggcattgaaattgtcaccattgcagctgcagagtccgataagccacgtgaagctatttccctggcggtgcgtgccgtgatttggcgtatttcagtcttttacttgggctctgttttggtcatcactttcctcatgccttatgagtcgatcaatggtgccgacaccgctgcggaatcccccttcacccaaatcctggcgatggcaaacatccctggcacggttggtttcatggaagcgatcatcgttctagcactgctttccgctttcaacgcccaaatctatgccacttctcgtttggtattttccatggcgaatcgacaagacgctccgcgagttttcagtaagctcagcaccagccacgtccccaccaatgcg

SEQ ID NO: 400 - protein, 337 aa, Corynebacterium glutamicum
MAKSNEGLGTGLRTRHLTMMGLGSAIGAGLFLGTGVGIRAAGPAVLLAYIIAGAIVVLVMQMLGEMAAARPASGSFSRYGEDAFGHWAGFSLGWLYWFMLIMVMGAEMTGAAAIMGAWFGVEPWIPSLVCVVFFAVVNLVAVRGFGEFEYWFAFIKVAVIIAFLIIGIALIFGWLPGSTFVGTSNFIGDHGFMPNGISGVAAGLLAVAFAFGGIEIVTIAAAESDKPREAISLAVRAVIWRISVFYLGSVLVITFLMPYESINGADTAAESPFTQILAMANIPGTVGFMEAIIVLALLSAFNAQIYATSRLVFSMANRQDAPRVFSKLSTSHVPTNA

SEQ ID NO: 401 - DNA, 784 bp, Corynebacterium glutamicum
  CDS (101)..(784): RXA00281
ggttgactctttggctttgatgccagcattcgccaaagcgtggccctctttaagaaagctactgaacacaacagagtaggtttatgcgacactggtgcgcatgatcaacgttgaaggcctcaccaaacaatatggtcaggtccgcgcagtcgatgatctgagcttcgaagtaaaacccggaatagtcaccggatttctcggccccaacggcgccggaaaatccaccacgatgcggctgatccttggcttagataatccaactgcagggcatgccacgatcgaaggacaaccctaccgatcgctcaaaaatcccctgaccaaagtgggagcactgcttgatgccaaagcaacacacccaaatagaacagcagaaaaccacctcaagtggatcgcccgtgcaaatgggctgtccaccaaaagagtcgatgaagttctcaccctcgtgggactgactggtgttgggtcaaagaagaccggtgggttttcactaggcatgggccaacgtctaggacttgctgcagcattgctcggcgatccggaatacttaattctcgacgaacccgtcaacggccttgacccagaaggcattcactgggtgcgcaccttgttgcaaaacatcgccaagcagggcagaaccgtgctcgtgagttcccacctgctgtccgagatggcgcaaactgcggaacatttgatcgtgattgggcgtggcaagctggtcgccgatatgcccatgcatgagtttgtgcgctcccattccgcttccacagttgtggtgcgggcagca

SEQ ID NO: 402 - protein, 228 aa, Corynebacterium glutamicum
MINVEGLTKQYGQVRAVDDLSFEVKPGIVTGFLGPNGAGKSTTMRLILGLDNPTAGHATIEGQPYRSLKNPLTKVGALLDAKATHPNRTAENHLKWIARANGLSTKRVDEVLTLVGLTGVGSKKTGGFSLGMGQRLGLAAALLGDPEYLILDEPVNGLDPEGIHWVRTLLQNIAKQGRTVLVSSHLLSEMAQTAEHLIVIGRGKLVADMPMHEFVRSHSASTVVVRAA

SEQ ID NO: 403 - DNA, 852 bp, Corynebacterium glutamicum
  CDS (1)..(852): RXN00570
acgagacctcggccccaagaaattggcaacgggcttgtcgcactgattttctccgcatccggacccatcgcagtgatcctggctgctgctgcagcgggaaacctttcgcctgatcaaacatcttcatggatcttcggagcatttttaggcaacggactgctcacgctgtggcttacctatatgtaccgcagcccgcaggcatacttctggacgattcccggaaccgtcatcgtgggcgactcacttacccacttaagtttcgctgaagttatcggcgcataccttgttaccggcgttgtggtgtttgcgctcggatggaccggtctcatcggacggatcatggcggtactgccaccaaccatcgtgatggccatggtcgcaggcattttcctccgcttcggactcgacctcatcgacgccagcgtgaccgacccgctcattgcacttcccatggtcatagtttttgtggcattgagcatgagtccccgcttggcaagcatcgccccacccgttgcagtagccgcagtagtgggaaccatcgttgccatcgcatccggcaaactagcgtccggaattctagacaacggaattatctcccgccccgtctttaccgccccagaattttccttcgccgccatcatggaactcgttgttcccttggcgatcaccgtagtcattgtccaaaacggccaaggcgtcgcagtgcttaaagcagcaggtcaccgccccggagtaaaccttgccgccgcggcctccggactgtggtccctacccatggcgttgatcggcaacatcaccacctgcctcaccggccccaccaacgcgctgatcgtcgccggagcaaaatcacac

SEQ ID NO: 404 - protein, 284 aa, Corynebacterium glutamicum
TRPRPQEIGNGLVALIFSASGPIAVILAAAAAGNLSPDQTSSWIFGAFLGNGLLTLWLTYMYRSPQAYFWTIPGTVIVGDSLTHLSFAEVIGAYLVTGVVVFALGWTGLIGRIMAVLPPTIVMAMVAGIFLRFGLDLIDASVTDPLIALPMVIVFVALSMSPRLASIAPPVAVAAVVGTIVAIASGKLASGILDNGIISRPVFTAPEFSFAAIMELVVPLAITVVIVQNGQGVAVLKAAGHRPGVNLAAAASGLWSLPMALIGNITTCLTGPTNALIVAGAKSH

SEQ ID NO: 405 - DNA, 498 bp, Corynebacterium glutamicum
  CDS (1)..(498): FRXA00570
ccaaccatcgtgatggccatggtcgcaggcattttcctccgcttcggactcgacctcatcgacgccagcgtgaccgacccgctcattgcacttcccatggtcatagtttttgtggcattgagcatgagtccccgcttggcaagcatcgccccacccgttgcagtagccgcagtagtgggaaccatcgttgccatcgcatccggcaaactagcgtccggaattctagacaacggaattatctcccgccccgtctttaccgccccagaattttccttcgccgccatcatggaactcgttgttcccttggcgatcaccgtagtcattgtccaaaacggccaaggcgtcgcagtgcttaaagcagcaggtcaccgccccggagtaaaccttgccgccgcggcctccggactgtggtccctacccatggcgttgatcggcaacatcaccacctgcctcaccggccccaccaacgcgctgatcgtcgccggagcaaaatcacac

SEQ ID NO: 406 - protein, 166 aa, Corynebacterium glutamicum
PTIVMAMVAGIFLRFGLDLIDASVTDPLIALPMVIVFVALSMSPRLASIAPPVAVAAVVGTIVAIASGKLASGILDNGIISRPVFTAPEFSFAAIMELVVPLAITVVIVQNGQGVAVLKAAGHRPGVNLAAAASGLWSLPMALIGNITTCLTGPTNALIVAGAKSH

SEQ ID NO: 407 - DNA, 1280 bp, Corynebacterium glutamicum
  CDS (1)..(1257): RXN00571
acacttgttccacaggtttacgaaatagtgatctacggcgctgtgctgtcagctgtacatgaagatccaacccagatcggtgcgctcagcccagcagtcgccggcacccttggttcctacgccatgatcggcgtgatgatcggtgctctatctgcaggtgccgttggtgaccgccttggtcgtcgcaaagttatgctcaccgcaatcgtctggttctctgtgggcatggcgctgaccgcgttcgcgtcctcgattgcgctgttcggtttcttgcgcttcctcaccggacttggcgtgggcatgatcgttgcaaccggcggcgcaatcatcgcggagttcgctccagcgaataggcgcaacttgttcaacgcaatcgtgtactccggtgtcccagccggtggcgtgctggcttctatccttgcactgctctttgaagatgtcatcggctggcgcggactcttcctcatcggtggatccccactactgttcctcctgccacttgcatacttcttcctcccagagtccccgcgctggctcacctcccgcggccgtgctgcggacgccaaagccctctgcgcacgctatgggctgccgacggaggaatttgtcgtcgaaaagcagcaggaaacaaagggcaccggattcgctggaattttctcctccaagtacctcatgggcaccattctcatcggcgcaatgagcttcatcgggctgctttcgacctacggcctgaacacctggttgccaaagatcatggaatccaacggcgcaacctcacatgattccctgtactccctgctgttcctcaacggcggcgcagtgttcggtggcctcatcgcatcctggttcgctgaccgcatcggcgcgaagaccgtgatcacctccaccttcgctctcgccgcgatctgcctcggagtcctgccaaacatctcctcctggccaatgatgtacaccgcaatcgcattcgcaggcgtcggcgtcctgggcacccaggttctcacctacggcctgacctcgaacttcttcggaaccgaatgccgcgcagcgggagttgcatggtgtgcaggattcggccgactcggcggaatcgtcggaccagcaatcggtggcctgatcatcggcgcaggattcggaccaagctccgcattcctcatcttcgcagcagctgccgcaatcggcgcggtctgcaccttgctgatcccgcgctccccagcagaagtagaggtcaaggtcgcgcaggaaccacttgcacgtgtctaaccccaattaattcgaaacaa

SEQ ID NO: 408 - protein, 419 aa, Corynebacterium glutamicum
TLVPQVYEIVIYGAVLSAVHEDPTQIGALSPAVAGTLGSYAMIGVMIGALSAGAVGDRLGRRKVMLTAIVWFSVGMALTAFASSIALFGFLRFLTGLGVGMIVATGGAIIAEFAPANRRNLFNAIVYSGVPAGGVLASILALLFEDVIGWRGLFLIGGSPLLFLLPLAYFFLPESPRWLTSRGRAADAKALCARYGLPTEEFVVEKQQETKGTGFAGIFSSKYLMGTILIGAMSFIGLLSTYGLNTWLPKIMESNGATSHDSLYSLLFLNGGAVFGGLIASWFADRIGAKTVITSTFALAAICLGVLPNISSWPMMYTAIAFAGVGVLGTQVLTYGLTSNFFGTECRAAGVAWCAGFGRLGGIVGPAIGGLIIGAGFGPSSAFLIFAAAAAIGAVCTLLIPRSPAEVEVKVAQEPLARV

SEQ ID NO: 409 - DNA, 1208 bp, Corynebacterium glutamicum
  CDS (1)..(1185): FRXA00571
cagatcggtgcgctcagcccagcagtcgccggcacccttggttcctacgccatgatcggcgtgatgatcggtgctctatctgcaggtgccgttggtgaccgccttggtcgtcgcaaagttatgctcaccgcaatcgtctggttctctgtgggcatggcgctgaccgcgttcgcgtcctcgattgcgctgttcggtttcttgcgcttcctcaccggacttggcgtgggcatgatcgttgcaaccggcggcgcaatcatcgcggagttcgctccagcgaataggcgcaacttgttcaacgcaatcgtgtactccggtgtcccagccggtggcgtgctggcttctatccttgcactgctctttgaagatgtcatcggctggcgcggactcttcctcatcggtggatccccactactgttcctcctgccacttgcatacttcttcctcccagagtccccgcgctggctcacctcccgcggccgtgctgcggacgccaaagccctctgcgcacgctatgggctgccgacggaggaatttgtcgtcgaaaagcagcaggaaacaaagggcaccggattcgctggaattttctcctccaagtacctcatgggcaccattctcatcggcgcaatgagcttcatcgggctgctttcgacctacggcctgaacacctggttgccaaagatcatggaatccaacggcgcaacctcacatgattccctgtactccctgctgttcctcaacggcggcgcagtgttcggtggcctcatcgcatcctggttcgctgaccgcatcggcgcgaagaccgtgatcacctccaccttcgctctcgccgcgatctgcctcggagtcctgccaaacatctcctcctggccaatgatgtacaccgcaatcgcattcgcaggcgtcggcgtcctgggcacccaggttctcacctacggcctgacctcgaacttcttcggaaccgaatgccgcgcagcgggagttgcatggtgtgcaggattcggccgactcggcggaatcgtcggaccagcaatcggtggcctgatcatcggcgcaggattcggaccaagctccgcattcctcatcttcgcagcagctgccgcaatcggcgcggtctgcaccttgctgatcccgcgctccccagcagaagtagaggtcaaggtcgcgcaggaaccacttgcacgtgtctaaccccaattaattcgaaacaa

SEQ ID NO: 410 - protein, 395 aa, Corynebacterium glutamicum
QIGALSPAVAGTLGSYAMIGVMIGALSAGAVGDRLGRRKVMLTAIVWFSVGMALTAFASSIALFGFLRFLTGLGVGMIVATGGAIIAEFAPANRRNLFNAIVYSGVPAGGVLASILALLFEDVIGWRGLFLIGGSPLLFLLPLAYFFLPESPRWLTSRGRAADAKALCARYGLPTEEFVVEKQQETKGTGFAGIFSSKYLMGTILIGAMSFIGLLSTYGLNTWLPKIMESNGATSHDSLYSLLFLNGGAVFGGLIASWFADRIGAKTVITSTFALAAICLGVLPNISSWPMMYTAIAFAGVGVLGTQVLTYGLTSNFFGTECRAAGVAWCAGFGRLGGIVGPAIGGLIIGAGFGPSSAFLIFAAAAAIGAVCTLLIPRSPAEVEVKVAQEPLARV

SEQ ID NO: 411 - DNA, 689 bp, Corynebacterium glutamicum
  CDS (1)..(666): RXA00962
gataaggccatcaaggcggatcacgacattagagaaggccacgatgagccagcaggtttcaaggatctgcttgtcgatcgctaccgctggatctccatttggttcgcgctcgccacatttgtcaccctgctcgcgtggtacggactgggcacatggttgcctcgcctcatggaaactgcaggttatgagttcggccatgcattgatgttcaccctggctctgaacctcggtgcagtgatcggatccgtggttactgcgtgggccggcgatcgcttcgggccaatccgttccggtgtcatcgctgcaggtatcgccggtattgcactgctcctgctgctcacttacccgcctgtcaccgcggtttatgtcattctcattttggctggcgtgggcacccacggcactcagatcctcatcattgcagctgtcgccaacttctacccaagcaacctgcgtggcacagcactgggctgggcgctaggtgtaggtcgtattggtgctgttgtggccccgcagctcgctggcctgctgctggcatggaacttgggcgtgaactccaacttcatcatgttcggcaccgctgcgctgctctctgcgctggctctcagcgtgttgctgcgcctgcagaaaacctacagcgtcacccacaaagtcgaaatccaaggctaaccccctttttcaactcacag

SEQ ID NO: 412 - protein, 222 aa, Corynebacterium glutamicum
DKAIKADHDIREGHDEPAGFKDLLVDRYRWISIWFALATFVTLLAWYGLGTWLPRLMETAGYEFGHALMFTLALNLGAVIGSVVTAWAGDRFGPIRSGVIAAGIAGIALLLLLTYPPVTAVYVILILAGVGTHGTQILIIAAVANFYPSNLRGTALGWALGVGRIGAVVAPQLAGLLLAWNLGVNSNFIMFGTAALLSALALSVLLRLQKTYSVTHKVEIQG

SEQ ID NO: 413 - DNA, 484 bp, Corynebacterium glutamicum
  CDS (101)..(484): RXA02811
cataatcactctttccagatagcggaatccctttgattgtaacttggctcacctcgattatgtgtttatgacatcacacgcaccagaatcgggaggacttgtgacagagtcaactctcggagcatcgaatagctcccaaacaattgaaaataaaggcctcaccatcttgggcatcagcggccgacgcttggctgcggtgctcattggctggttttttgtcattttcgacggctacgacctcattgtgtacggcaccgtccaatcggccctggctaaggagtggaacttaagctctgcaacgctgggcaccatcggctccaccgcgttctttggcatggcgatcggcgctgtgttcattggtcgactgtcagaccgcgtgggccgaaaagcagcggtgattggatccgtgctgattctctctgtcttcaccatgctgtgtgcatttgctccaaacccatgggtgttcggcgctttccgtttcatc

SEQ ID NO: 414 - protein, 128 aa, Corynebacterium glutamicum
VTESTLGASNSSQTIENKGLTILGISGRRLAAVLIGWFFVIFDGYDLIVYGTVQSALAKEWNLSSATLGTIGSTAFFGMAIGAVFIGRLSDRVGRKAAVIGSVLILSVFTMLCAFAPNPWVFGAFRFI

SEQ ID NO: 415 - DNA, 1197 bp, Corynebacterium glutamicum
  CDS (1)..(1197): RXA02115
acccgcgcaaccaaaagtgtcggaacagttctcgcactcctgtggttcgcaattgtcctcgacggctttgacctagtcgtcctgggtgcaacaatcccgtccatgctggaggatcccgcgtgggatctcactgctggacaggccacacagatttccaccatcggcctcgtcggcatgaccattggcgcactgaccatcggtttcttaacggaccgtctgggtcgacgccgtgtcatgctgttctctgtggcagtattttctgtattcactctcctgctggcattcaccaccaacgtccagctcttcagcctgtggcgtttcctcgcaggtgttggccttggtggagcactccccaccgcaattgccatggtgaccgagttccgccccggcaccaaagcgggctctgcatccaccaccttgatgaccggctaccacgtcggcgcagtagcaaccgccttccttggcctcttccttatcgacggctttggttggcactccatgttcatcgcaggtgccgtaccaggactgatcctgctaccactgctgtacttcttccttccagaatccccgcagtacctcaaaatctccggcaagttggatgaggcgcaggcagttgcagcatcttatggactttccctggatgatgatcttgatcgcgaacacgaagaagaactcggcgagtcctcctcactttcctccctgttcaagccctcgttccgccgcaacaccctggcgatttggggcacctcattcatgggactcctcctggtctacggcctgaacacatggctgccacaaatcatgcgccaagcagactacgacatgggtaactcgcttggattcctcatggtgctcaacatcggcgcagtgatcggcctttatattgcagggcgaattgccgataagaactcccctcgcaaaacagcactcgtatggttcgtgttctctgcattttccctcgcgttgcttgctgtccggatgccactgatcggtctgtatggcatcgtgctgctcaccggcatctttgtgttcagctcccaggtactcatctacgccttcgttggtgagaatcaccctgccaagatgcgcgcaaccgccatgggattctccgcaggaattggtcgcctcggcgccatctctggcccgttgcttggtggtctgcttgtcagtgccaaccttgcttacccatggggcttc

SEQ ID NO: 416 - protein, 399 aa, Corynebacterium glutamicum
TRATKSVGTVLALLWFAIVLDGFDLVVLGATIPSMLEDPAWDLTAGQATQISTIGLVGMTIGALTIGFLTDRLGRRRVMLFSVAVFSVFTLLLAFTTNVQLFSLWRFLAGVGLGGALPTAIAMVTEFRPGTKAGSASTTLMTGYHVGAVATAFLGLFLIDGFGWHSMFIAGAVPGLILLPLLYFFLPESPQYLKISGKLDEAQAVAASYGLSLDDDLDREHEEELGESSSLSSLFKPSFRRNTLAIWGTSFMGLLLVYGLNTWLPQIMRQADYDMGNSLGFLMVLNIGAVIGLYIAGRIADKNSPRKTALVWFVFSAFSLALLAVRMPLIGLYGIVLLTGIFVFSSQVLIYAFVGENHPAKMRATAMGFSAGIGRLGAISGPLLGGLLVSANLAYPWGF

SEQ ID NO: 417 - DNA, 1288 bp, Corynebacterium glutamicum
  CDS (101)..(1288): RXN00590
tctaaactcactctcaactcaccaagattgttcaacaatctgcgattggtgtgcaatctaccccaatcattttgaaagcccccacgaaaggagcgcgacaatggccgacaacaaaaatgccgatgacagccagctagtctcagccagcactggaacccctgggcctggcgacattgcaaaagccaatgcgccatccctcaagcaagctgcagtaaccgcctctggccgaagcgctctgatgggtgccatcttcctcatggcaacttctgccatcggcccagggttcctcacccaaaccgctgtcttcaccaaccagctcggcgcagctttcgcatttgcgatcctggtgtcgatcctcattgacatcgcggtgcagctgaatgtgtggcgcatcatcggcgtctctgaaatgcgcgcccaagaactcggcaacacggttatcccaggttttggttgggtgctggccgtactggtctgtattggcggcgtagtattcaacatcggcaacatcgccggtggtggccttgggcttaacgcgctgcttggctgggacgtcaaagttggtggcgtgatcaccgcggccatcgcgattgcgatcttcttgttcaagcgacttggtgctgctctggacaaattcctcgtggtcctcggcgtcgtgatgatcctgctcaccgtctacgtggctttcgtctcccaacctccagttggctcggcgctgaagaatgcagtacttcctgacaccatcgactggcttgtcatcaccacacttgtgggtggaaccgtcggtggatacatcacttacgctggcgcacaccgcatgctggactccggacgaaccggccccaacaacgtcaaagctgtttccaattcctctatcaccggcatcctgatcactggcctcatgcgcgtggtgctcttcctcgcggttctcggtgttgtcgcaggtggcgtcaccctatccaccacgggcaacccagccgcggaagcattccagcacgctgcaggcgatatcggactacgcatcttcggcgccgtgctgtgggcagcgtccatttcctcagtcatcggcgccagctacacctctgcaaccttcctggtggaaaacaagccagagaagaagcgtctgcaaaactgggtgaccatcatcttcatcctgatttcttgctccgtgttcatcatgctcggcacggcaccagcaatcctcttggtcttcgccggagcattcaacggtttggtcctccccgtaggctttaccctgatgatctacgtagcgatcttccgccaaaaa

SEQ ID NO: 418 - protein, 396 aa, Corynebacterium glutamicum
MADNKNADDSQLVSASTGTPGPGDIAKANAPSLKQAAVTASGRSALMGAIFLMATSAIGPGFLTQTAVFTNQLGAAFAFAILVSILIDIAVQLNVWRIIGVSEMRAQELGNTVIPGFGWVLAVLVCIGGVVFNIGNIAGGGLGLNALLGWDVKVGGVITAAIAIAIFLFKRLGAALDKFLVVLGVVMILLTVYVAFVSQPPVGSALKNAVLPDTIDWLVITTLVGGTVGGYITYAGAHRMLDSGRTGPNNVKAVSNSSITGILITGLMRVVLFLAVLGVVAGGVTLSTTGNPAAEAFQHAAGDIGLRIFGAVLWAASISSVIGASYTSATFLVENKPEKKRLQNWVTIIFILISCSVFIMLGTAPAILLVFAGAFNGLVLPVGFTLMIYVAIFRQK

SEQ ID NO: 419 - DNA, 487 bp, Corynebacterium glutamicum
  CDS (101)..(487): FRXA00590
tacgctggcgcacaccgcatgctggactccggacgaaccggccccaacacgtcaaagctgtttccaattctctatcaccggcatcctgatcactggcctcatgcgcgtggtgctcttcctcgcggttctcggtgttgtcgcaggtggcgtcaccctatccaccacgggcaacccagccgcggaagcattccagcacgctgcaggcgatatcggactacgcatcttcggcgccgtgctgtgggcagcgtccatttcctcagtcatcggcgccagctacacctctgcaaccttcctggtggaaaacaagccagagaagaagcgtctgcaaaactgggtgaccatcatcttcatcctgatttcttgctccgtgttcatcatgctcggcacggcaccagcaatcctcttggtcttcgccggagcattcaacggtttggtcctccccgtaggctttaccctgatgatctacgtagcgatcttccgccaaaaa

SEQ ID NO: 420 - protein, 129 aa, Corynebacterium glutamicum
MRVVLFLAVLGVVAGGVTLSTTGNPAAEAFQHAAGDIGLRIFGAVLWAASISSVIGASYTSATFLVENKPEKKRLQNWVTIIFILISCSVFIMLGTAPAILLVFAGAFNGLVLPVGFTLMIYVAIFRQK

SEQ ID NO: 421 - DNA, 490 bp, Corynebacterium glutamicum
  CDS (101)..(490): FRXA01538
tctaaactcactctcaactcaccaagattgttcaacaatctgcgattggtgtgcaatctaccccaatcattttgaaagcccccacgaaaggagcgcgacaatggccgacaacaaaaatgccgatgacagccagctagtctcagccagcactggaacccctgggcctggcgacattgcaaaagccaatgcgccatccctcaagcaagctgcagtaaccgcctctggccgaagcgctctgatgggtgccatcttcctcatggcaacttctgccatcggcccagggttcctcacccaaaccgctgtcttcaccaaccagctcggcgcagctttcgcatttgcgatcctggtgtcgatcctcattgacatcgcggtgcagctgaatgtgtggcgcatcatcggcgtctctgaaatgcgcgcccaagaactcggcaacacggttatcccaggttttggttgggtgctggccgtactggtctgtattggcggcgta

SEQ ID NO: 422 - protein, 130 aa, Corynebacterium glutamicum
MADNKNADDSQLVSASTGTPGPGDIAKANAPSLKQAAVTASGRSALMGAIFLMATSAIGPGFLTQTAVFTNQLGAAFAFAILVSILIDIAVQLNVWRIIGVSEMRAQELGNTVIPGFGWVLAVLVCIGGV

SEQ ID NO: 423 - DNA, 1401 bp, Corynebacterium glutamicum
  CDS (101)..(1378): RXA01727
agcttttggtggtttcaccacctgcgctcgtcttaattttgcgtgttccagagagacccttgaggaggggctgcgccgtatcgccagcgtgttgtaaataatgagtaaaaagtctgtcctgattacttctttgatgctgttttccatgttcttcggagctggaaacctcatcttcccgccgatgcttggattgtcggcaggaaccaactatctaccagctatcttaggatttctagcaacgagtgttctgctcccggtgctggcgattatcgcggtggtgttgtcgggagaaaatgtcaaggacatggcttctcgtggcggtaagatctttggcctggtgtttcctattgctgcctatttgtctatcggcgcgttttacgcgctgccgaggactggggcggtgagctattcgacggcggttggcgtcgataatgcgctttattcgggcttgtttaactttgtgttttttgcggtggcactggcgttgtcgtggaatccgaatggcattgcagacaagttgggtaagtggctcacgccagcgttgctcacgttgattgtggtgctggtggtgttgtcggtagccaagttggatggcacgccaggtgagccaagtagtgcgtatgcgcagcagcctgcgggggcgggtttgcttgagggctacatgacgatggatgcgattgctgcgttggcgtttggcatcgtggtgatttctgcgttcaagtaccaaaaggttaacaaggtccgcacggcaactgtcgtgtcggcgttcattgccggaattttgttggcgctggtttatcttggtttgggctcaatcggtcaagtagtaaacggtgagttcgctgatggcaccgcaattttgaactacgctgcactgtccacgatgggtcaggctggtcgcatcatgttcgtggctattttgatccttgcatgtatgaccaccgcagttggtctgatcagtgcgacgtctgagtttttcaattcgctgctgccaggtgtcaagtaccacgtctgggccactgttttcgcgctgatttcctttggcgttgccaccatgggtttggatacggtgttggccgttgcggctccagtgattagtttcatttacccatcggccatcaccttggtgttcttgtcgctcatcgagcccctgctgttccgtctcaagtggacctacctattcggcatttggactgcagttgtgtgggcgctgttcatgtctatccctgcgctgaatccattcatcgaatgggcgccgctgcacagcatgtctttgggttgggttgtcccagttctcgtggcctctgccatcggtttggctattgattggaacaagaaaggtgcccagtctgttgcaaagaaggaatccatttccgtctaatcgctaattgcgaggagtct

SEQ ID NO: 424 - protein, 426 aa, Corynebacterium glutamicum
MSKKSVLITSLMLFSMFFGAGNLIFPPMLGLSAGTNYLPAILGFLATSVLLPVLAIIAVVLSGENVKDMASRGGKIFGLVFPIAAYLSIGAFYALPRTGAVSYSTAVGVDNALYSGLFNFVFFAVALALSWNPNGIADKLGKWLTPALLTLIVVLVVLSVAKLDGTPGEPSSAYAQQPAGAGLLEGYMTMDAIAALAFGIVVISAFKYQKVNKVRTATVVSAFIAGILLALVYLGLGSIGQVVNGEFADGTAILNYAALSTMGQAGRIMFVAILILACMTTAVGLISATSEFFNSLLPGVKYHVWATVFALISFGVATMGLDTVLAVAAPVISFIYPSAITLVFLSLIEPLLFRLKWTYLFGIWTAVVWALFMSIPALNPFIEWAPLHSMSLGWVVPVLVASAIGLAIDWNKKGAQSVAKKESISV

SEQ ID NO: 425 - DNA, 1461 bp, Corynebacterium glutamicum
  CDS (101)..(1438): RXA00623
tttaagcttcgtcggcaacgatcacaccacgttaaatttcgaccatcaatgacggtggccgttttttggcgaatccccaaaaaggtcgaagaggaagttcatggattcaaacacagaatcttcaagtgttgaggtcaaaaacgaacacattaaagttcaaaagccgccgaagaaggaccgcactcactggctctacattgcggtcattatcgcattgattggcggtattaccctaggcctgatttcaccggagttgggcaaagaattcaagattttgggcaccatgtttgtgtccttgatcaagatgattatcgctccagttattttctgcaccatcgtcatcggaatcggttcagtcaaggcagcggcaacagtcggacgcgctggtggcatcgcccttgcgtacttcatcacgatgtccacattcgcactcgcagttggcctgctagtcggtaacttcatccagccaggtagcggactgaacatctcagttgatgaagaatcttcattcgcatccacagagagcagccctgaaggactcttgggattcatccactcgatcatccctgaaacgttcttctctgcatttactgatggttcggtgctgcaggtactgttcatcgccatcctcgtgggctttgcagctcagtcgatgggtgaaaagggacagcccatccttgatttcgtatcccatctgcagaagctcatcttcaagattttgaactggattctgtggctcgccccagtcggtgcattcggtgcaatggccggcgtcgttggcgaaacaggctttgatgccgttgttcagctcggtattttgatcctcgccttttacgtcacctgcgtgatcttcatctttggcgtgctgggcgccgtactgaaggtgttcaccggcgtgaatatcttcaagctggtcaagtaccttgccaaggaattcctgctgatctttgctacctcatcctctgaatctgccttgccaaacctcatgcgcaagatggaacacatcggtgtggctaaaccaaccgtcggaatcgtggtcccaaccggctattccttcaacttggacggcaccgcaatttacctcaccatggcatctatcttcattgccgacgcgatgaatatgccgatgagcctcggcgagcaggtcggtctgcttgtcttcatgatcatcgcatccaagggcgctgctggtgtctcgggtgccggtattgcaacgttggctgccggattgtcttcacaccgcccagaacttctgcacggcgttgacgtgattgtgggcatcgataaattcatgtctgaagcccgcgcactaaccaacttcgccggaaactccgtggcaacactgctggtcggcaagtggactggcaccgtggacatgaaccaagtccatgacgttttgaatggaaaatctccatttgtggagttagaagaagaccactagttttcaacaggacgacaacg

SEQ ID NO: 426 - protein, 446 aa, Corynebacterium glutamicum
MDSNTESSSVEVKNEHIKVQKPPKKDRTHWLYIAVIIALIGGITLGLISPELGKEFKILGTMFVSLIKMIIAPVIFCTIVIGIGSVKAAATVGRAGGIALAYFITMSTFALAVGLLVGNFIQPGSGLNISVDEESSFASTESSPEGLLGFIHSIIPETFFSAFTDGSVLQVLFIAILVGFAAQSMGEKGQPILDFVSHLQKLIFKILNWILWLAPVGAFGAMAGVVGETGFDAVVQLGILILAFYVTCVIFIFGVLGAVLKVFTGVNIFKLVKYLAKEFLLIFATSSSESALPNLMRKMEHIGVAKPTVGIVVPTGYSFNLDGTAIYLTMASIFIADAMNMPMSLGEQVGLLVFMIIASKGAAGVSGAGIATLAAGLSSHRPELLHGVDVIVGIDKFMSEARALTNFAGNSVATLLVGKWTGTVDMNQVHDVLNGKSPFVELEEDH

SEQ ID NO: 427 - DNA, 620 bp, Corynebacterium glutamicum
  CDS (55)..(597): RXA01584
ccacccccttccccgctacgcgccataccggcttgggcgggcatcggatcactagtggtgtttttgggcgcacttctcggcgccgtaatcatgggcgggttttatccagcattcattcaagccggatccacagtgttcggcggcggccacgtggttttgccactgctggaaaagctcgttgttgcgcccggttttattaaagaaaccgacttcctatccggctactccgcagcgcaggcagtgcctggccccatgttcagcttcgccagctacctcggcgcaatctacggtggcatcggtggtgcagtgctggccagcctggcgatcttcttccccgccgcactcttgagcatcagcggaatgtacttttggggacgctggcgaaaagcaccgcgcatccaagcagcagtcaccggcatcaacgccggtgtggtggggcttttgggcgcagcgctctacgatcccgtattcacccacggcatcaccagcgtttccgcattagctatcgcaacggtgtgttggctggggctagcccactggaaaattccgccgtgggccatcgccgcgggtgcggcccttgcaggctgggtcttgctttagaaaacgctcagacccaaacc

SEQ ID NO: 428 - protein, 181 aa, Corynebacterium glutamicum
VVFLGALLGAVIMGGFYPAFIQAGSTVFGGGHVVLPLLEKLVVAPGFIKETDFLSGYSAAQAVPGPMFSFASYLGAIYGGIGGAVLASLAIFFPAALLSISGMYFWGRWRKAPRIQAAVTGINAGVVGLLGAALYDPVFTHGITSVSALAIATVCWLGLAHWKIPPWAIAAGAALAGWVLL

SEQ ID NO: 429 - DNA, 813 bp, Corynebacterium glutamicum
  CDS (101)..(790): RXA00852
agatcaccgtcatggtcataatcgccgctggagttcatgcagcattccctgacatccgtaagaaatagttccaacccacttttcctcagaattgcagttcatgcccgagatcatttttgacaacactgaagtacgctacgatgactcgctcattttagagcccctatcgttaaaactgacagaacaacgcattggcatcatcggggctaacggcggtggaaaatccacgctcatcagaatgatcaatggtctcggcgaaccaaccacagggcgtgttctagttgatggccttgacgtctcgcattccggacgggaagttcgcaagaaggttggatttgtcttctctgacgctgaaaaccagatcgtgatgccaactgtgcgtgaggatattgccttctcgcttcgccggcacaaaatgccacgcgctgaaaaggcgcaacgtgtcgacgagatgatggcgcgattcaacttgagcgagcatgcagatcaatcaccgcacaccctatccggtggtcaaaagcagttgttagcgctggctgcagtactgattttggagccagaagtgatcatcgctgatgagcccactaccctgctggatctgcgcaataggctgatgatcaaagacgtgttcaataaactcgagcagcaattaatcgttgtcagccatgatttagatttcctcagcgattttgagcgggtcatttgcatcaatgatcataaaatcgctgctgatggccctccgcaaaagtccattgacctgtacgtatcgcttatggcggaacctgcgaaatgaacagtattcctttaggtttt

SEQ ID NO: 430 - protein, 230 aa, Corynebacterium glutamicum
MPEIIFDNTEVRYDDSLILEPLSLKLTEQRIGIIGANGGGKSTLIRMINGLGEPTTGRVLVDGLDVSHSGREVRKKVGFVFSDAENQIVMPTVREDIAFSLRRHKMPRAEKAQRVDEMMARFNLSEHADQSPHTLSGGQKQLLALAAVLILEPEVIIADEPTTLLDLRNRLMIKDVFNKLEQQLIVVSHDLDFLSDFERVICINDHKIAADGPPQKSIDLYVSLMAEPAK

SEQ ID NO: 431 - DNA, 1269 bp, Corynebacterium glutamicum
  CDS (101)..(1246): RXA00690
atggatcattggactcacactggctgtcatttccttggtttcagcgtctgctgtggcggcgtgggcgattcgtcgttcagaggtccagggttaaagcttcgtgaaatggattgagcgatatgtgctgtcccggcggatggttcatccctgggcgtggtgggtgtgggcgttgggtattgctggttgtgccagcatgaccaacaatccttatattttggcgctcacttttgccacgttgtgttttgtggtgtttaaccgtcgtgggtcatcgccgtggtcgcgtgctttcccgatctatttgatgatcgcgggttggctcgtggtgtaccggttggtcatgcacattgtggtgggagcaaaaattggcaccattgaactgtttcggatcccgccggtgcagttgccggaatgggctgcgggtatccacgtgtttggcacggtgtatctcgagggtctgatcatcgcgacgacgcaaggcttaacgcttggaacgatgatcgtggcggtgggtgctgcgaactctttggcggatcccaagaagctgctcaaatcgttgcctggcgcattgggcgaactgggaactgcggtggtcatcggtatttccattgcacctcagatggctgagtcggcgttccgcattaatcgtgcacgaaccttgcgtggtgatgatgccaaaggtgttcgtggtttcgcgcggattttgatgccggttttccaggacactttggataggtctttggccctggctaattccatggatgcccgtggttatggcaggcaggctcatgtatccaaattccaacagcgtgtgacctctatttttggtgcattcggaatactcggcgtgaccgttggtctgtttgtggtcttagatgcatcatcaccgatgttcgttgccgttccggtgtttattaccggcgtgggcttcttgatcatttcgttggtcgttgcttcacatagaaaaacatccaccacttttgatcagttgccttggggtgctgcggaatggcttgtgtgcatcacaggtgtgattccgctgctcatggctgcgctgacacgataccttgatccaggttccatgatcaccacctgggttcctttgcatatgccagacaccgttccgttgctcgttgtggcaggacttgttgtggcgacgatgccaggattcttgacgccccgcttgccgaagaacaaagtgagggtcaagcgtcgaaaagcaataaatagcccagaaagggccgaagtttaatgagtgctccttttagcgcg

SEQ ID NO: 432 - protein, 382 aa, Corynebacterium glutamicum
VKWIERYVLSRRMVHPWAWWVWALGIAGCASMTNNPYILALTFATLCFVVFNRRGSSPWSRAFPIYLMIAGWLVVYRLVMHIVVGAKIGTIELFRIPPVQLPEWAAGIHVFGTVYLEGLIIATTQGLTLGTMIVAVGAANSLADPKKLLKSLPGALGELGTAVVIGISIAPQMAESAFRINRARTLRGDDAKGVRGFARILMPVFQDTLDRSLALANSMDARGYGRQAHVSKFQQRVTSIFGAFGILGVTVGLFVVLDASSPMFVAVPVFITGVGFLIISLVVASHRKTSTTFDQLPWGAAEWLVCITGVIPLLMAALTRYLDPGSMITTWVPLHMPDTVPLLVVAGLVVATMPGFLTPRLPKNKVRVKRRKAINSPERAEV

SEQ ID NO: 433 - DNA, 876 bp, Corynebacterium glutamicum
  CDS (101)..(853): RXA00827
tgcgtgaattaacagacaacggaatcagcattgtgtcagtaacccatgatcctgatttcatcgcagcgctgggcgatcaccacattgaggtgagcgcgaagtgaacctgctgatcaaaattaatcccgtcacccgcatcatcgcgttgatggtactgaccacgccgttgctgctgagtttggatgtgatgtcggcagcgatcgcgctggtggcaaccattattctggcaccatttgccggcgtgacctggaagatgctgctgaaacgtggctggatgctgttcctcatggcaccggtggctgcattatccatggcgctttatggcaggccggatggaaaagagtactttagcttcctgctcattcacgtcactgataattcactggctttggctgctgccattgggctgcgtgttctggcgattggtctgcccgttgtggtgctgattgctcgcattgatcccaccgacctgggcgatggtttggcgcagctgctcaaactgcctgaaaggtttgtcatcggtgctgtggcaggaagccgactgatgacgctttttcgggaagattggtactccatgtccagggcaaggcgtgcccgcggaattgctgatcagggcaagatcaagcactttttcaccatgacttttggtttgttggtgctctcgcttcgccgtggatccaagcttgcaacggcgatggaagcacgcggttttggtcgcacgactggccgcacctgggcaagggaatccaccgtcggcgcgcgcgatctggtgctcatcttggtgtgtgctgccatttccgcgatcgctctaaccgtgtccattcagactggtttctttaagttcttgggcacatgatcacagttttaattgatgga

SEQ ID NO: 434 - protein, 251 aa, Corynebacterium glutamicum
VNLLIKINPVTRIIALMVLTTPLLLSLDVMSAAIALVATIILAPFAGVTWKMLLKRGWMLFLMAPVAALSMALYGRPDGKEYFSFLLIHVTDNSLALAAAIGLRVLAIGLPVVVLIARIDPTDLGDGLAQLLKLPERFVIGAVAGSRLMTLFREDWYSMSRARRARGIADQGKIKHFFTMTFGLLVLSLRRGSKLATAMEARGFGRTTGRTWARESTVGARDLVLILVCAAISAIALTVSIQTGFFKFLGT

SEQ ID NO: 435 - DNA, 732 bp, Corynebacterium glutamicum
  CDS (101)..(709): RXA00851
ttgagcgggtcatttgcatcaatgatcataaaatcgctgctgatggccctccgcaaaagtccattgacctgtacgtatcgcttatggcggaacctgcgaaatgaacagtattcctttaggtttttacgtcgataagcaatctgttgttcattcttttcctgctttgtggaaattcccacttctgctgtttttcatcatcggcggctccatcgcggcttctaccccggttcatgggttgattttggtggggattgcagtggtgttttacgtgctggcgaagattccgctgaaggtcgcgtgggagcagttgtggccagtgctgccgattttgatcatgctcggtgcgtttcagtggtggcagcgcggctttgatttcgcggcaaccacagtgctcacgctgttttccgcggtgatggccgccatgttgttgacgttgaccacgcggttggaagcgctcatgaatgcagttgagcggatgttgcagccttttgcacgttttggcctgccagtagagacgatcaccttggctatttctctcacgattcggctcattccgctgcaattagccacggtgaaggaagtcctcgatgcccgtaaagctcgtggtgccggtttttctatcgccgcgtttggcacgcctgtgatcatcagatcaataaagagggcccgcaatatcggcgatgctcttctcgcacgtggtgccggcgattaatttctttcaacacatagcaa

SEQ ID NO: 436 - protein, 203 aa, Corynebacterium glutamicum
MNSIPLGFYVDKQSVVHSFPALWKFPLLLFFIIGGSIAASTPVHGLILVGIAVVFYVLAKIPLKVAWEQLWPVLPILIMLGAFQWWQRGFDFAATTVLTLFSAVMAAMLLTLTTRLEALMNAVERMLQPFARFGLPVETITLAISLTIRLIPLQLATVKEVLDARKARGAGFSIAAFGTPVIIRSIKRARNIGDALLARGAGD

SEQ ID NO: 437 - DNA, 725 bp, Corynebacterium glutamicum
  CDS (3)..(695): RXS03220
ccatgggcttaagggaaattttgtccagcaagtggcttgtgcgcatcctcctggtaggtatcggattgggtgtcgcacagcagctgaccggcatcaactccatcatgtactacggccaggttgttctcattgaggctggtttctccgagaatgcagctctgatcgccaacgtggcgccaggagtgatcgcagttgtcggtgcattcatcgcactgtggatgatggatggtatcaaccgccgtaccaccctcattaccggttattctctcaccaccattagccacgtattgatcggtatcgcatccgtagcattcccagtcggcgatcctcttcgcccctacgttatcttgactctggttgtggtcttcgtgggatccatgcagaccttcctcaacgtagctacctgggttatgctctctgagctcttcccgctggcaatgcgcggtttcgcaatcggtatctcagtgttcttcctctggatcgcaaacgcgttcctcggattgttcttcccaaccatcatggaagcagtaggactaaccggaaccttcttcatgttcgccggaatcggtgtggttgccttgatcttcatctacacccaggttcctgaaactcgtggacgtaccttggaggagattgatgaggatgttacttccggtgtcattttcaacaaggacatccgaaaaggaaaggtgcactaaaaacccagacactgcatagataacacg

SEQ ID NO: 438 - protein, 231 aa, Corynebacterium glutamicum
MGLREILSSKWLVRILLVGIGLGVAQQLTGINSIMYYGQVVLIEAGFSENAALIANVAPGVIAVVGAFIALWMMDGINRRTTLITGYSLTTISHVLIGIASVAFPVGDPLRPYVILTLVVVFVGSMQTFLNVATWVMLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 439 - DNA, 408 bp, Corynebacterium glutamicum
  CDS (101)..(385): FRXA02762
ttcccagtcggcgatcctcttcgcccctacgttatcttgactctggttgtggtcttcgtgggatccatgcagaccttcctcaacggtagctacctgggttatgctctctgagctcttcccgctggcaatgcgcggtttcgcaatcggtatctcagtgttcttcctctggatcgcaaacgcgttcctcggattgttcttcccaaccatcatggaagcagtaggactaaccggaaccttcttcatgttcgccggaatcggtgtggttgccttgatcttcatctacacccaggttcctgaaactcgtggacgtaccttggaggagattgatgaggatgttacttccggtgtcattttcaacaaggacatccgaaaaggaaaggtgcactaaaaacccagacactgcataga

SEQ ID NO: 440 - protein, 95 aa, Corynebacterium glutamicum
MLSELFPLAMRGFAIGISVFFLWIANAFLGLFFPTIMEAVGLTGTFFMFAGIGVVALIFIYTQVPETRGRTLEEIDEDVTSGVIFNKDIRKGKVH

SEQ ID NO: 441 - DNA, 789 bp, Corynebacterium glutamicum
  CDS (101)..(766): RXN00092
cgaaaccagaaacacccagcggctcctcgtcgaaaagcgaatctttgaactagaagcccaggcacgttggctcgaccgaattgaagcattggagcagtaaatgacaaacacgcctttcccccttgaacttcaaaacatctcctgcgccttcggagaaggcccacgccacgtctccgcgctcaacaacgtctcgctggcagtcaatcccggcgaactcgttgccatcatgggcccgtccggctcaggaaaatccaccttgctcaacgtcgccggcctcctgcagcgcgcaacctctggccatgtgcttatcgacggtgccagcgcctcagacctcaacgccaaacgcgcagctgaaaccaggcgtcgccacatcggagttattttccaaaactacaacctggtccccaccctcaccgtcggagaaaacgtcggtctgcccctagaactcgacggcaaaaccgaccgccaggcagtagcaatcgcactcgcggaagtcggcctcgaaggcttcgacgaccgcttccccgaagagatctccggcggccaagcccagcgcgtcgccatcgcgagagccctcatcggcccccgaaaaatcttgcttgccgacgaacccaccggcgccctcgacacctccaccggcgacgcagtcctccgcgtcctccgccaaagaatcgattccggtgccgcaggcctccttgtcacccacgaaccccgcttcgccgcgtgggcagaccgaacaatcatgcttagggatggtgaaatccagtgaccacacttctagcagcaacc

SEQ ID NO: 442 - protein, 222 aa, Corynebacterium glutamicum
MTNTPFPLELQNISCAFGEGPRHVSALNNVSLAVNPGELVAIMGPSGSGKSTLLNVAGLLQRATSGHVLIDGASASDLNAKRAAETRRRHIGVIFQNYNLVPTLTVGENVGLPLELDGKTDRQAVAIALAEVGLEGFDDRFPEEISGGQAQRVAIARALIGPRKILLADEPTGALDTSTGDAVLRVLRQRIDSGAAGLLVTHEPRFAAWADRTIMLRDGEIQ

SEQ ID NO: 443 - DNA, 227 bp, Corynebacterium glutamicum
  CDS (1)..(204): FRXA00092
atcgcgagagccctcatcggcccccgaaaaatcttgcttgccgacgaacccaccggcgccctcgacacctccaccggcgacgcagtcctccgcgtcctccgccaaagaatcgattccggtgccgcaggcctccttgtcacccacgaaccccgcttcgccgcgtgggcagaccgaacaatcatgcttagggatggtgaaatccagtgaccacacttctagcagcaacc

SEQ ID NO: 444 - protein, 68 aa, Corynebacterium glutamicum
IARALIGPRKILLADEPTGALDTSTGDAVLRVLRQRIDSGAAGLLVTHEPRFAAWADRTIMLRDGEIQ

SEQ ID NO: 445 - DNA, 975 bp, Corynebacterium glutamicum
  CDS (101)..(952): RXN03060
tatgtcctttggctccggtaccctggcaggagtacctgggctgtttttctaaaatggcctgacgttttcaagattgaatttaaggaaagcatcgtagttcatgagtaaccctgccgcgagcacacctgccaacaattcggacgatgttgcgaaggagaattgggactcttcttttacgccgaagactgacattgactcttcccagcctgtcaataactcgactggtgaagccgctgcgcgcgcagtgaacctgtacaaggcgtatggccagggtgataccactgtcaccgcgttggatcacgtcaacgtggagtttgagaagaacaagttcactgccatcatgggtccttctggctcgggtaagtccacgttgatgcactgcatggctggtctggatgctgcgactggtggttcggcattcattggtgatacggatctgtcgcggttgaaggacaaagagatgacctctttgcgtcgtgatcgtttgggattcattttccagtcgttcaacttggttcctactctgacggcgtcggagaacattacgctgcctaccgatatcgcgggccgcaagattgatcagtcgtggttcgatgagattacctctcgtctgggtctgactgagcgccttaagcaccgtcctgcagagctctctggtggtcagcagcagcgtgtggcgtgtgctcgtgcgttggtgtctcgtccggagatcattttcggcgacgagccaaccggtaacttggattcgaactcttctagggaagtgctggatatcctgcgcaccgcagttgatcaggatgatcagaccgttgtgatcgttacccacgatgccaaggcggcgtcctatgcagatcgtgtcattttcttggcggacggtcgtatcgtgaaccagttgtttgatcccaccatcgaggaaatcttggccacgatgaacggaattgaggatattgcctaatgaattccggttccacaatg

SEQ ID NO: 446 - protein, 284 aa, Corynebacterium glutamicum
MSNPAASTPANNSDDVAKENWDSSFTPKTDIDSSQPVNNSTGEAAARAVNLYKAYGQGDTTVTALDHVNVEFEKNKFTAIMGPSGSGKSTLMHCMAGLDAATGGSAFIGDTDLSRLKDKEMTSLRRDRLGFIFQSFNLVPTLTASENITLPTDIAGRKIDQSWFDEITSRLGLTERLKHRPAELSGGQQQRVACARALVSRPEIIFGDEPTGNLDSNSSREVLDILRTAVDQDDQTVVIVTHDAKAASYADRVIFLADGRIVNQLFDPTIEEILATMNGIEDIA

SEQ ID NO: 447 - DNA, 538 bp, Corynebacterium glutamicum
  CDS (101)..(538): FRXA02618
cgaaaccagaaacacccagcggctcctcgtcgaaaagcgaatctttgaactagaagcccaggcacgttggctcgaccgaattgaagcattggagcagtaaatgacaaacacgcctttcccccttgaacttcaaaacatctcctgcgccttcggagaaggcccacgccacgtctccgcgctcaacaacgtctcgctggcagtcaatcccggcgaactcgttgccatcatgggcccgtccggctcaggaaaatccaccttgctcaacgtcgccggcctcctgcagcgcgcaacctctggccatgtgcttatcgacggtgccagcgcctcagacctcaacgccaaacgcgcagctgaaaccaggcgtcgccacatcggagttattttccaaaactacaacctggtccccaccctcaccgtcggagaaaacatcggtctgcccctagaactcgacggcaaaaccgaccgccaggcagtagcaatcgcactcgcggaagtcggcctcaagggctctacgaccgcttttcccgagagatctctg

SEQ ID NO: 448 - protein, 146 aa, Corynebacterium glutamicum
MTNTPFPLELQNISCAFGEGPRHVSALNNVSLAVNPGELVAIMGPSGSGKSTLLNVAGLLQRATSGHVLIDGASASDLNAKRAAETRRRHIGVIFQNYNLVPTLTVGENIGLPLELDGKTDRQAVAIALAEVGLKGSTTAFPERSL

SEQ ID NO: 449 - DNA, 975 bp, Corynebacterium glutamicum; identical to SEQ ID NO: 445
  CDS (101)..(952): FRXA02900

SEQ ID NO: 450 - protein, 284 aa, Corynebacterium glutamicum; identical to SEQ ID NO: 446

SEQ ID NO: 451 - DNA, 1452 bp, Corynebacterium glutamicum
  CDS (1)..(1452): RXS03212
gcctcacttaactggtcagtcatcgttccagccctagtcattgtcctagcgacagtggtgtggggtatcggattcaaagatagctttaccaactttgctagttctgcgttgtcagcagtagttgacaatctcggctgggccttcattttgtttggcacagtctttgtattttttatcgttgttatcgccgctagtaaattcggcacgattcgcttaggccgcattgatgaagcaccagagtttcgcacggtgtcatggatttccatgatgtttgctgcaggtatgggtattggtttgatgttctacggaaccacagaacctttaaccttctaccgcaatggtgtacctggacatgatgaacacaatgttggcgttgctatgtccacgacaatgttccactggaccttgcatccatgggctatctacgcaattgtgggcctagccattgcctattcgaccttccgagtgggccgtaaacagcttctaagctctgcattcgtgccactcattggtgaaaaaggtgcagaaggatggttgggcaagctcatcgacatcctggcgattatcgccaccgtattcggcacggcatgttcccttggccttggtgccctgcagattggtgcaggcctgtccgcagcaaacatcattgaagatccaagcgattggaccatcgttggcattgtttctgttttgaccctggcatttatcttctccgctatttctggtgtgggcaagggaatccagtacctctccaacgccaacatggttctggcagctctgctcgcgattttcgtgttcgttgtcggaccaaccgtgtcgattttgaacctgctgccaggttctattggcaactacctgtccaacttctttcaaatggcaggccgcactgccatgagtgccgacggcacagcaggtgagtggctaggtagctggaccatcttctactgggcatggtggatctcttggtcaccattcgtaggaatgttcttggcacgtatttcccgtggccgctccatccgtgagttcatcctgggcgtgttgctcgtcccagcaggtgtgtccaccgtatggttctccatttttggtggcactgcgattgtcttcgaacaaaatggggaatccatttggggtgatggtgcagcagaagagcagctttttggattgcttcatgcacttccaggtgggcaaatcatgggcatcatcgccatgattttgctgggtactttcttcattacctctgctgactctgcttccaccgtcatgggcaccatgagtcagcacggccagctggaagccaacaagtgggtgacagctgcctggggtgttgctaccgcagctattggactaacgctattgctttctggtggtgacaatgccttgagcaacttgcaaaacgtcaccatcgtggctgcaacaccattcttgtttgtggttattggattgatgtttgcg

SEQ ID NO: 452 - protein, 484 aa, Corynebacterium glutamicum
ASLNWSVIVPALVIVLATVVWGIGFKDSFTNFASSALSAVVDNLGWAFILFGTVFVFFIVVIAASKFGTIRLGRIDEAPEFRTVSWISMMFAAGMGIGLMFYGTTEPLTFYRNGVPGHDEHNVGVAMSTTMFHWTLHPWAIYAIVGLAIAYSTFRVGRKQLLSSAFVPLIGEKGAEGWLGKLIDILAIIATVFGTACSLGLGALQIGAGLSAANIIEDPSDWTIVGIVSVLTLAFIFSAISGVGKGIQYLSNANMVLAALLAIFVFVVGPTVSILNLLPGSIGNYLSNFFQMAGRTAMSADGTAGEWLGSWTIFYWAWWISWSPFVGMFLARISRGRSIREFILGVLLVPAGVSTVWFSIFGGTAIVFEQNGESIWGDGAAEEQLFGLLHALPGGQIMGIIAMILLGTFFITSADSASTVMGTMSQHGQLEANKWVTAAWGVATAAIGLTLLLSGGDNALSNLQNVTIVAATPFLFVVIGLMFA

SEQ ID NO: 453 - DNA, 945 bp, Corynebacterium glutamicum
  CDS (1)..(945): FRXA01591
gcctcacttaactggtcagtcatcgttccagccctagtcattgtcctagcgacagtggtgtggggtatcggattcaaagatagctttaccacctttgctagttctgcgttgtcagcagtagttgacaatctcggctgggccttcattttgtttggcacagtctttgtattttttatcgttgttatcgccgctagtaaattcggcacgattcgcttaggccgcattgatgaagcaccagagtttcgcacggtgtcatggatttccatgatgtttgctgcaggtatgggtattggtttgatgttctacggaaccacagaacctttaaccttctaccgcaatggtgtacctggacatgatgaacacaatgttggcgttgctatgtccacgacaatgttccactggaccttgcatccatgggctatctacgcaattgtgggcctagccattgcctattcgaccttccgagtgggccgtaaacagcttctaagctctgcattcgtgccactcattggtgaaaaaggtgcagaaggatggttgggcaagctcatcgacatcctggcgattatcgccaccgtattcggcacggcatgttcccttggccttggtgccctgcagattggtgcaggcctgtccgcagcaaacatcattgaagatccaagcgattggaccatcgttggcattgtttctgttttgaccctggcatttatcttctccgctatttctggtgtgggcaagggaatccagtacctctccaacgccaacatggttctggcagctctgctcgcgattttcgtgttcgttgtcggaccaaccgtgtcgattttgaacctgctgccaggttctattgtgaactacctgtccaacttctttcaaatggtaggccgcactgccatgagtgccgacggcacaccaggtgagtggcttggtggctgcaccatcttctac

SEQ ID NO: 454 - protein, 315 aa, Corynebacterium glutamicum
ASLNWSVIVPALVIVLATVVWGIGFKDSFTTFASSALSAVVDNLGWAFILFGTVFVFFIVVIAASKFGTIRLGRIDEAPEFRTVSWISMMFAAGMGIGLMFYGTTEPLTFYRNGVPGHDEHNVGVAMSTTMFHWTLHPWAIYAIVGLAIAYSTFRVGRKQLLSSAFVPLIGEKGAEGWLGKLIDILAIIATVFGTACSLGLGALQIGAGLSAANIIEDPSDWTIVGIVSVLTLAFIFSAISGVGKGIQYLSNANMVLAALLAIFVFVVGPTVSILNLLPGSIVNYLSNFFQMVGRTAMSADGTPGEWLGGCTIFY

SEQ ID NO: 455 - DNA, 292 bp, Corynebacterium glutamicum
  CDS (101)..(292): RXN00201
acgtcgcggacttcaagtagtcggcgatgaaaaagtccgtttactaaaccccgatctgtgttacgccatcgcgcggctcgggcacaccgatacctgggcagtggcagattgcggattacccatcccagaacacgtagagatcatcgatttggcactcgtgtttgggatccccacctttgaacaagtactgaatgctctcaagccggaagtagttgtggaaggcgcggtgattgccgaaggggcaccccaacgtatccgcgaaatggtggatacggatgtggaagtatgtgcg

SEQ ID NO: 456 - protein, 64 aa, Corynebacterium glutamicum
VADCGLPIPEHVEIIDLALVFGIPTFEQVLNALKPEVVVEGAVIAEGAPQRIREMVDTDVEVCA

SEQ ID NO: 457 - DNA, 286 bp, Corynebacterium glutamicum
  CDS (101)..(286): FRXA00201
acgtcgcggacttcaagtagtcggcgatgaaaaagtccgtttactaaaccccgatctgtgttacgccatcgcgcggctcgggcacaccgatacctgggcagtggcagattgcggattacccatcccagaacacgtagagatcatcgatttggcactcgtgtttgggatccccacctttgaacaagtactgaatgctctcaagccggaagtagttgtggaaggcgcggtgattgccgaaggggcaccccaacgtatccgcgaaatggtggatacggatgtggaagtt

SEQ ID NO: 458 - protein, 62 aa, Corynebacterium glutamicum
VADCGLPIPEHVEIIDLALVFGIPTFEQVLNALKPEVVVEGAVIAEGAPQRIREMVDTDVEV

SEQ ID NO: 459 - DNA, 849 bp, Corynebacterium glutamicum
  CDS (101)..(826): RXA01221
tccagggtgcgatcctggttctcgtgatcgtgttgctgccgggcggaattgcttcaattaaactttccgcgctcaaaaataaggccaggaaggccacctcatgagccttaaaatcaccaacctcaaagtcgctttcgggtcgttcatcgccgtgaatgagattagttttcaggtgctgcccggtcacgtccacttcctcatcggtgccaacggtgcaggtaaaaccacctgcattgacgcgatcagcggattggcgccggggcagggatcagtgcagttggatggcactgagattctgggaacccctgtgcaccgcattgctcggatgggtgtggggcgaacgtttcagaccgccagcgtgtttgaagaattgtctgtgttgcagaatctggatattgcgtgcgggattcatcgtccgttgcgggcgcttctcggggtgcgtcatcggattgatccccgaattgaacacgccctggaggtcacgggtcttgctgatctggtgaatgctcaggcgggaaccttgtcgcatgggcagaaacagtggctggaaattgcaatgttgctggtgcaggatgcgcaggtgctcatgctggatgagccggtggcgggcatgagtgaggaggagcgtgtcgcaacgggtgagcttttgcagagggttgcgcggggacgggtggtgttggtggtggagcacgatatggagttcatgcgtcgttttgccactcgcgtcactgtgatgaatcgcggcacgatcttgtgtgaggggtcggtcgatgagattcaggcgaatccggatgtgcagtccatttatttaggtacggcagggaagtgagttagtcatgttggaaatca

SEQ ID NO: 460 - protein, 242 aa, Corynebacterium glutamicum
MSLKITNLKVAFGSFIAVNEISFQVLPGHVHFLIGANGAGKTTCIDAISGLAPGQGSVQLDGTEILGTPVHRIARMGVGRTFQTASVFEELSVLQNLDIACGIHRPLRALLGVRHRIDPRIEHALEVTGLADLVNAQAGTLSHGQKQWLEIAMLLVQDAQVLMLDEPVAGMSEEERVATGELLQRVARGRVVLVVEHDMEFMRRFATRVTVMNRGTILCEGSVDEIQANPDVQSIYLGTAGK

SEQ ID NO: 461 - DNA, 822 bp, Corynebacterium glutamicum
  CDS (101)..(799): RXA01222
aatcgcggcacgatcttgtgtgaggggtcggtcgatgagattcaggcgaatccggatgtgcagtccatttatttaggtacggcagggaagtgagttagtcatgttggaaatcactaatttgtgtgcaggttatggccgcacgcaggtacttcattctctttcaatctccacgagcagcaacggcatcctgtcgatcctcggccacaatggcgctggtaaatccaccttgctgcgaaccgcggtggggttgattaagccgacttccggagaggtcaaacttttcggccaggatgtcacctcgttgtccacgcatgagcgagtaaagcgcggaatggcttatgtgccgcagggccagcagtcttttacgcagcttagttgcatggaaaatttgcaggtggtagcggatctgcagggacgtgtgggcaaggcacgcatcgcggaggcgcttgatcgctttccggcgctgacccaggtgctggaccgccaagccggcctgttgtcgggtggtcagcgtcagcagcttgccatcgcccgcgcgctgatcacggcgccaaagcttttgcttctcgacgaacccaccgagggtattcagccttcggtggttgctgaaattcagcagaccatcatcgatttggctaaggacggcatgagcattgtcctggtggagcaaaacattggttttgcattggatgctgcaacaagctacgccattgtggcgcgtggtcaggtcgtggaatcgggacaaggcgctgaaaccaccgcagagaagcagactaaagtgcgggaatctctagcaatctagcggctgtggatagcgttttg

SEQ ID NO: 462 - protein, 233 aa, Corynebacterium glutamicum
MLEITNLCAGYGRTQVLHSLSISTSSNGILSILGHNGAGKSTLLRTAVGLIKPTSGEVKLFGQDVTSLSTHERVKRGMAYVPQGQQSFTQLSCMENLQVVADLQGRVGKARIAEALDRFPALTQVLDRQAGLLSGGQRQQLAIARALITAPKLLLLDEPTEGIQPSVVAEIQQTIIDLAKDGMSIVLVEQNIGFALDAATSYAIVARGQVVESGQGAETTAEKQTKVRESLAI

SEQ ID NO: 463 - DNA, 1005 bp, Corynebacterium glutamicum
  CDS (101)..(982): RXA01219
caccatttgggaaaccgattccccagttgatccggacccatacttgtcttcctatgactgggccaagaccaccgctgcgacttcctaagagataaaaatcatggacattttactcaatcagctcgtagccgggctttcagttggatcggtccttctattggtcgcagtgggattgtcactgacctttggacagatgggcgttattaatatggcgcacggagagttcatcatggtcggcgcatacaccgcatatgtggtgcagctggtcgtcggttctgccggtttatccctactgatcagcattccgctggcctttattatcggtgggcttttcggagttctcctcgaacaattcctgctgaagtatctttatcacaggccactagacacgctgctggccacattcggtgtcggtttgatccttcagcagctggcccgaaacattttcggagctcccgcagtggatgtcagggcaccggaatttctccgcggaaacgtcgaagttctaggcgtcttggtgccgaccgcgcgactattcatcctggcgctggccatcgcatcagtgactgcactagctgtgttcctaaatcgcactgcctggggccgacgcatccgcgccgtggttctgaaccgcgacctcgcggaaaccgcaggtattgatacccgagctactgaccgaatgacgttctttgtgggctccggtcttgccggaatcgccggggtagctatcacattgattggcgcgaccggccccaccatcggtcagaactacatcgtggatgccttccttgttgttgccgccggtggcatcggccgggtgaagggcgctgtgatcatggctttcgtgctgggaattactcaagcattcgtggaatatacgacaggtgcgagcatcgcgaagttcatcgtactcatcgctgttgttgccttcctgcagtttaggcctcaaggactcttccaaacccaaactaggagcctcgtatgagcactcaactcaagctgaag

SEQ ID NO: 464 - protein, 294 aa, Corynebacterium glutamicum
MDILLNQLVAGLSVGSVLLLVAVGLSLTFGQMGVINMAHGEFIMVGAYTAYVVQLVVGSAGLSLLISIPLAFIIGGLFGVLLEQFLLKYLYHRPLDTLLATFGVGLILQQLARNIFGAPAVDVRAPEFLRGNVEVLGVLVPTARLFILALAIASVTALAVFLNRTAWGRRIRAVVLNRDLAETAGIDTRATDRMTFFVGSGLAGIAGVAITLIGATGPTIGQNYIVDAFLVVAAGGIGRVKGAVIMAFVLGITQAFVEYTTGASIAKFIVLIAVVAFLQFRPQGLFQTQTRSLV

SEQ ID NO: 465 - DNA, 1200 bp, Corynebacterium glutamicum
  CDS (101)..(1177): RXA01220
caggtgcgagcatcgcgaagttcatcgtactcatcgctgttgttgccttcctgcagtttaggcctcaaggactcttccaaacccaaactaggagcctcgtatgagcactcaactcaagctgaagaagcccgcaaagaagaaaactacgccgaaacttagcgtcgtaaatgctcccacgctgcgcactgcggcgttgggcctggccgcgctcgctgcggtattgctgtgcgccccgctctttttatccacattccagctgacgttgatgtcgcgcttggtgtgttatgcgatcgtcgcagtcggcatcgggctggcgtggggcagaggcggcatgctcacgctggggcaaggcgtgttctttggaatcggcgcgtacatcatggccatgcacatgctgtacagcgattcgcagatttttgggaccacagttccgcaatggtggtccatttttgccaacccggcagtcgcactcatcgcagttgtggcgcttcccggcatcgtggcttttgtgctcggcttctccattttcaaacgacgcatcaaaggcgcctactttgccatcgtgaaccaagcgctcgccgcagctgttgtggtgttgctggtcggacaacaagattcccttggaggttccaatggtctttccggatttcgatcgttcatgggttttgccgtctacgaccccatcaaccgcatcatgttttacttcaccgcagtgggagttctcttggctttggtggctatctcatattggctcatgcgcagccgctatggagaactgctcgtggccaccagagatgcagaagaacgcgtccgattcctcggatatgatcccgcattgatcaaaaccgccgcatatgtcattgctgcgatgattgccggaatcgccggagcgctgttcgtgccgatcgtgggcatcatttcacccgcagaaatcggcgtggtgccatcaatcgtgttcgtgatcgccgtcgccgctggtggcagggcatccctattcggtcccgtagttggcgcgctggtgctgggctgggtggaatccacacttgctcaaactttccccagcatgtggtcctatttccagggtgcgatcctggttctcgtgatcgtgttgctgccgggcggaattgcttcaattaaactttccgcgctcaaaaataaggccaggaaggccacctcatgagccttaaaatcaccaacctc

SEQ ID NO: 466 - protein, 359 aa, Corynebacterium glutamicum
MSTQLKLKKPAKKKTTPKLSVVNAPTLRTAALGLAALAAVLLCAPLFLSTFQLTLMSRLVCYAIVAVGIGLAWGRGGMLTLGQGVFFGIGAYIMAMHMLYSDSQIFGTTVPQWWSIFANPAVALIAVVALPGIVAFVLGFSIFKRRIKGAYFAIVNQALAAAVVVLLVGQQDSLGGSNGLSGFRSFMGFAVYDPINRIMFYFTAVGVLLALVAISYWLMRSRYGELLVATRDAEERVRFLGYDPALIKTAAYVIAAMIAGIAGALFVPIVGIISPAEIGVVPSIVFVIAVAAGGRASLFGPVVGALVLGWVESTLAQTFPSMWSYFQGAILVLVIVLLPGGIASIKLSALKNKARKATS

SEQ ID NO: 467 - DNA, 876 bp, Corynebacterium glutamicum
  CDS (101)..(853): RXA00091
tcatgaaccacgtgttccgcgcacaaggcgtcgtgtccatcattattgagatggtcggcggtaccgtcttcctcatcgtcatcctcagaaagggcagactgtgattacgttaactaatgtccgcaaggaatactccagcgacgttgccatcggccccgtcaaccttgagatcccagccggcggcatcaccgcgttggtcggcccaaacggtgcaggcaagtcaacactgctcaccatgatcggtcgactcctcggcatcgatgaaggcaacatcaccgtagcctcctacgatgtcacctcaaccgcatccaaagatctggccaagatcatctccatcctgcgccaggaaaaccactttgttaccaagctgaccgtgcgccagctcgtaggtttcggacgcttcccatatagcaagggccggctgacggaagaagacgagggaatcatctcccgctacatcgacttcttcaatctcaccgaactcgaagaccgctacctcgaccagctttccggcggccagcgccagcgcgcctatgtcgccatggtgctgtgccaagagacggactacgtgcttctcgacgaacccctcaacaatcttgatatcgcacactcggtggaaatgatgaaacacctcgagaatgctgcagcccaatttggccgcaccatcatcgtggttcttcacgacatcaacttcgccgcgcgctacgccgattacatcgtggccgtaaagcacggaatgatcgaaaaagagggaacacctgaacagatcatgaaaaacgagatcctttcagaaatcttcaatacagagatcgaagttattgaaggaccacacggcaagattgcttgctaccactaaatgaagagaaataagccgac

SEQ ID NO: 468 - protein, 251 aa, Corynebacterium glutamicum
VITLTNVRKEYSSDVAIGPVNLEIPAGGITALVGPNGAGKSTLLTMIGRLLGIDEGNITVASYDVTSTASKDLAKIISILRQENHFVTKLTVRQLVGFGRFPYSKGRLTEEDEGIISRYIDFFNLTELEDRYLDQLSGGQRQRAYVAMVLCQETDYVLLDEPLNNLDIAHSVEMMKHLENAAAQFGRTIIVVLHDINFAARYADYIVAVKHGMIEKEGTPEQIMKNEILSEIFNTEIEVIEGPHGKIACYH

SEQ ID NO: 469 - DNA, 692 bp, Corynebacterium glutamicum
  CDS (79)..(669): RXA00228
ccgcatggcatccgccgaaagaattcccctccggaggaatggcacgcctcatgggagaacgcatcggcaaaaactgacatgcgcgacctccgctccatgatcggcgtcagctcctccgcattaggcaaccgaatcccctccgaagaaaaagtctctgacctagtcatctccgcaggctacgcaatcctcggccgctggcgcgaagactacgacgaaatggacttcggacaagccaccgaaatcctcgaacaagtcggagccatgcacctagccgaccgcacctggggaaccctctccgaaggcgaacgcaaacgagtcctggtcgcacgcgcactcatgaccaacccggaactcctcatccttgacgaaccaaccgcaggaatggacctcggcggacgcgaagacctcgtcggctacctcggagaactcgccatggacccagacgcacctgccatcgtcatgatcacccaccacgtcgaagaaatccccgccggattcacccacgcaatgctcctcgacgaaggtgaaatcgtagcccaaggcctgatcaacaccgtcatgacaaacgagaacctatccaaagcattccaccagccaatccaagtagaccgcatcggggaacgctactttgcccgccgtgtgagaaccgccaggagtcatagggctcagtaggttttttggagttgtgggcc

SEQ ID NO: 470 - protein, 197 aa, Corynebacterium glutamicum
MRDLRSMIGVSSSALGNRIPSEEKVSDLVISAGYAILGRWREDYDEMDFGQATEILEQVGAMHLADRTWGTLSEGERKRVLVARALMTNPELLILDEPTAGMDLGGREDLVGYLGELAMDPDAPAIVMITHHVEEIPAGFTHAMLLDEGEIVAQGLINTVMTNENLSKAFHQPIQVDRIGERYFARRVRTARSHRAQ

SEQ ID NO: 471 - DNA, 813 bp, Corynebacterium glutamicum
  CDS (101)..(790): RXA00346
atctatgagacccctcaaaacaccgagaatttcctcgatgcattcaccaaggcagttgatgatctcaccgctgccactaaccaggtttagaattatttaaatgctgttgactttcaatgatgctgcggtggatcccctctggaggggcctgaatttagagctccgacagggggaatttcttgcggttttaggccccaacggcgtgggaaaatccacgctcatcggtacgattttgggcacccgaaaactcacccacggttcggttaaaactgatgcccgggtgggttatattccgcaacaacgaattttcgatgtcccgttgcgtgcccgcgatatggtttcgctgtccgcggcgcatggcgtggtttccaaaaggggacccgcgaagggtgacgtcgataagcttcttgcccgcgtgggcgcttccggaatcgccgatcgacgcgtcggcgagctctccggcgggcagcagcagctcgtccgccaagcccaggcccttgccacgcgcccgcaattattgcttgccgacgaacccctcctcagccttgaccccggcgtcgcgcagcgcacggtgtccctatttggtgaattgaaggccgaaggcgtcggcgttgttgtggtcacccacgatgtcaatccactaatgggcctggtagatcgcattttgtacctcgcccccaacggccacaccatcggcacggttggcgatgtcatgcagtccgaaaaactcagcgaactctacaacgcacccgtcacggtggctcgcatcaacgacagaatcgtggtggtttaagtggatctatccacctggct

SEQ ID NO: 472 - protein, 230 aa, Corynebacterium glutamicum
MLLTFNDAAVDPLWRGLNLELRQGEFLAVLGPNGVGKSTLIGTILGTRKLTHGSVKTDARVGYIPQQRIFDVPLRARDMVSLSAAHGVVSKRGPAKGDVDKLLARVGASGIADRRVGELSGGQQQLVRQAQALATRPQLLLADEPLLSLDPGVAQRTVSLFGELKAEGVGVVVVTHDVNPLMGLVDRILYLAPNGHTIGTVGDVMQSEKLSELYNAPVTVARINDRIVVV

SEQ ID NO: 473 - DNA, 433 bp, Corynebacterium glutamicum
  CDS (101)..(433): RXA00524
tcctcggcacccgctaccccgtcggagttgtcaccggcgcattcggcgccccattccttatctatttactcattcgttccaaccgcgcgggagtaaccctgtgaccaccaaccatcaactatccgccgaagaaatttccctggcgtacggcgagcgcaccatcatcgattcgctcagcgtcgacatcgtccccggcaaaatcacctccatcgtcggccccaacggatgcggcaaatcaacgctgctgcgcgcctttgcgcgcctccttaaacctagcgccgggcaagcgcttatcgacgcccacccccttccttcactgccaggcaaagaactagctcgcatgctcgggctgttaccgcaatcccccaccggacctgaaggcatcgtcgtcgccgacctcgtgggccgcggccgccacccccaccaaggactc

SEQ ID NO: 474 - protein, 111 aa, Corynebacterium glutamicum
VTTNHQLSAEEISLAYGERTIIDSLSVDIVPGKITSIVGPNGCGKSTLLRAFARLLKPSAGQALIDAHPLPSLPGKELARMLGLLPQSPTGPEGIVVADLVGRGRHPHQGL

SEQ ID NO: 475 - DNA, 900 bp, Corynebacterium glutamicum
  CDS (101)..(877): RXA01823
gcaacacgttgatactgagctgcacacgcccgttggcctggtgaccagtttgctgggcggggtgtatttgatgtggcttttgagccgaaaggaggcataaatgctgcaagcgcatgatctcacgctgagttacggcgggcgaaatattgtagaagggctcagtctggaccttccggaaagaggcctcagcatcatcattggccccaacggatgcgggaaatcaaccgttttgaaagcgttgggcagactgctgaaaccacaattggggaagatcacgctaggtgggcgagatatttccagcatgggcaccaagcatgtggcgaaacacatcggggtgcttccgcaacccccatatgcgcccgatggggtgagcgtcacggagctggtcagccgcgggcggtatccgcaccaacatctgctgtcgcaatggtcgaaagacgatgaagccattgtggcgcgctcgctggcggaagtcggcatgcacacccatgctgagcatttagtgtcggaactttcaggcggccagcgccaacgggcgtggatcgccatggcgctcgctcaggaaacagacattttgcttctcgacgagcccaccacgttcctcgacgtagcccaccaaatatccgtcctcgatttatgctccgacctgcaccaacgtggtcgcaccctggccattgttctacacgatctgaacatggctgcacggtatgccacccacatcatcgccatgcgggacggcaccatcatcgaccaaggaaaacccgaagaaatactcactaaagcgctgctcaaagaagtttttgacctcgacgcactcatcctcaaagaccccaacaacggccgaccactcatcgtgcccacagacaggagaaactcatgaaagaaaccgacaacctactg

SEQ ID NO: 476 - protein, 259 aa, Corynebacterium glutamicum
MLQAHDLTLSYGGRNIVEGLSLDLPERGLSIIIGPNGCGKSTVLKALGRLLKPQLGKITLGGRDISSMGTKHVAKHIGVLPQPPYAPDGVSVTELVSRGRYPHQHLLSQWSKDDEAIVARSLAEVGMHTHAEHLVSELSGGQRQRAWIAMALAQETDILLLDEPTTFLDVAHQISVLDLCSDLHQRGRTLAIVLHDLNMAARYATHIIAMRDGTIIDQGKPEEILTKALLKEVFDLDALILKDPNNGRPLIVPTDRRNS

SEQ ID NO: 477 - DNA, 906 bp, Corynebacterium glutamicum
  CDS (101)..(883): RXA02767
gggaaaacgtttcctcgccgcccacagaatcataaaaattttctgaggttgtcatgggtaccagtctaagccctggccttacgccagtaaggtgttacccatgcgcgaactagcactcaacatggccggcgtcaccgtgcggcgcggcgagaaattgcttctcgacgatatctccctctcaattccgcaagggtcgcactgggccgtacttggtccaaatggcgccggtaaaaccaccatgctgaagatcgcagccaccttgctgtacccatcggaaggcaccgtggacatcctggggcatcgctttggtcgggtggatactcgtgagctgcggaaaacaatcggcctggtggacccgaagcaaagatttaccaacctgccggcccacgaaattgtgctgtcggggttaaccgcctccaacgggttgttgccacggtggtcggcttcggcttcggagttggagcggtgcgctttgatgttggagttggtgggcatgacagcgcgtgccgatcgttactgggccgatatgagccagggcgaaaaagcccgcaccctgattgctcgtgcgctgattatctcaccgaccctactgctgcttgatgaacccaccaccggccttgacctgcccggacgtgaaactttgctcagtgtgattgatggtttgcgagccgctcttcctggtctgacgacagtgatgatcacccaccacgtcgaagagatcgccgcctccacgacagatatcctcatgatcaaggacgcccgcatactggcttcggggactgtttcagaagtgatgactcctgaaaatttgggcgcgctgtatgacatgtcggtgtcgttggaaactgtgcgcagccggtggttcgcgttcgatgctctgcattaaaaggggctagttttacacaa

SEQ ID NO: 478 - protein, 261 aa, Corynebacterium glutamicum
MRELALNMAGVTVRRGEKLLLDDISLSIPQGSHWAVLGPNGAGKTTMLKIAATLLYPSEGTVDILGHRFGRVDTRELRKTIGLVDPKQRFTNLPAHEIVLSGLTASNGLLPRWSASASELERCALMLELVGMTARADRYWADMSQGEKARTLIARALIISPTLLLLDEPTTGLDLPGRETLLSVIDGLRAALPGLTTVMITHHVEEIAASTTDILMIKDARILASGTVSEVMTPENLGALYDMSVSLETVRSRWFAFDALH

SEQ ID NO: 479 - DNA, 876 bp, Corynebacterium glutamicum
  CDS (101)..(853): RXA02792
agaacaaagtgctgcccatactcatgaactttgccgaacccccaaccccgctggccgtcgatggcctagaaaaaatcatcgactttgtggaaacccacccatgatcgaggccacacacctacgccacagttttggcgacaacatcgtcatcgatgacgtcaccctccatctacctgcacacggcaccgtcagcttggtcggccccaacggcagtggcaaaaccaccctgctgcgtgcactatacggagcactgcaaccaaatgaagggcacatccacgtagatggcgttccactaataagcttgcaccgcaaagacatcgcaaaaaccatggccgtagtcatccaagaacatgactccgacctccccatgaccgtcgctgacctggtcttactaggcagactcccccaccaaaagatgtttgccggcaactctcaagctgatcagttactcgttaaggaagcactcacccgagtcggcgccattcacctggccgaccgacaattcggcgcactttcaggcggtgaacgccaacgcgtcctcatcgcacgagcactcgtacaaaacgccacacacattctgctcgacgaacccaccaaccacctcgacatccgctaccagcacgaagtccttcacctcgtccgcgaactcagctcaagttccatcatcgtcctccacgacctcaacctcgcaggtgcctacagcgaccacatcatcctccttgaccaaggacgtgtggttactcaaggaacgccctcagaggtattgaccccagagcatttggaacctgtgtatggcgttcgtgttgagcgctttgacctaggcgatgaagtccaccttcggttcaagcgtcactaggagttttgttgaggaggtgg

SEQ ID NO: 480 - protein, 251 aa, Corynebacterium glutamicum
MIEATHLRHSFGDNIVIDDVTLHLPAHGTVSLVGPNGSGKTTLLRALYGALQPNEGHIHVDGVPLISLHRKDIAKTMAVVIQEHDSDLPMTVADLVLLGRLPHQKMFAGNSQADQLLVKEALTRVGAIHLADRQFGALSGGERQRVLIARALVQNATHILLDEPTNHLDIRYQHEVLHLVRELSSSSIIVLHDLNLAGAYSDHIILLDQGRVVTQGTPSEVLTPEHLEPVYGVRVERFDLGDEVHLRFKRH

SEQ ID NO: 481 - DNA, 1161 bp, Corynebacterium glutamicum
  CDS (101)..(1138): RXN02929
caggtggggacctcgcgtatcccagctggtggaagaaatcgcagcgcagttgaatcagcttgcttcttctgaagctgtgccggccgctgcttaagttttcgtgctgaagagaattttcctcaacccctgggtggctaccgcgttgtcggtagtcattttggggtttgtggtgctgttttcaggttttagcggtgttattgatttaagccccacagcagtgattagacatttgagtgggcaggacacgctcacccctcgagatcaggccatcttctttgatatccggctgcctcgaattatcgctggtgtcattgtcggagcaacgctggctatttctggtgcttcttaccaagcggtatttagaaacccgctggctgatccttatttgttgggtgtgtccgcaggttctggccttggtgtcacggcagtgattgttggcggtaccgtgctgggattttctgcaccgagcatcggcgtgattggtgcagcatttgtaggtggtgttgccgcagtacttgccacgctgatggtgagtcggggagtaggacagggatcatcaaccaccgtggttattttggcgggcgtggcggttgctgcttttgccagttccatccagacctatattcagcaacgacacatcgatacggtggcgcgcgtatatgtgtggatgttgggcaacctcaatgtcaccaactggatgtcgatcttcatcgtggctgtggtggcgggactatgcgcggccgtgatcatgtcctgcgccaggttgttagacgtgatggctgttggtgatgtggaagcccgcacattgggcgtcgatccaggcctcgtacgcattggcattgtcatcgtggcaacccttggtacagctgcagtggtatccatttccggtctcatcgggtttgtgggcatcattgttccgcacgccctgcgcctaattgttggcccggggcatcggattttactgccactgtctttcgtatggggtgccattttcctcgtgttggcagataccgcagggcgaacattgatggctcctcaggaacttcccgtgggtgtggtgacagctgcactcggcgcaccgttcttcttatttattttgcgcagaaccagcagacaacgagttccaaaaaggagtgcttaagtggcgatcattgaatgcga

SEQ ID NO: 482 - protein, 346 aa, Corynebacterium glutamicum
VLKRIFLNPWVATALSVVILGFVVLFSGFSGVIDLSPTAVIRHLSGQDTLTPRDQAIFFDIRLPRIIAGVIVGATLAISGASYQAVFRNPLADPYLLGVSAGSGLGVTAVIVGGTVLGFSAPSIGVIGAAFVGGVAAVLATLMVSRGVGQGSSTTVVILAGVAVAAFASSIQTYIQQRHIDTVARVYVWMLGNLNVTNWMSIFIVAVVAGLCAAVIMSCARLLDVMAVGDVEARTLGVDPGLVRIGIVIVATLGTAAVVSISGLIGFVGIIVPHALRLIVGPGHRILLPLSFVWGAIFLVLADTAGRTLMAPQELPVGVVTAALGAPFFLFILRRTSRQRVPKRSA

SEQ ID NO: 483 - DNA, 1095 bp, Corynebacterium glutamicum
  CDS (101)..(1072): FRXA01235
ttctgaagctgtgccggccgctgcttaagttttcgtgctgaagagaattttcctcaacccctgggtggctaccgcgttgtcggtagtcattttggggtttgtggtgctgttttcaggttttagcggtgttattgatttaagccccacagcagtgattagacatttgagtgggcaggacacgctcacccctcgagatcaggccatcttctttgatatccggctgcctcgaattatcgctggtgtcattgtcggagcaacgctggctatttctggtgctgcttaccaagcggtatttagaaacccgctggctgatccttatttgttgggtgtgtccgcaggttctggccttggtgtcacggcagtgattgttggcggtaccgtgctgggattttctgcaccgagcatcggcgtgattggtgcagcatttgtaggtggtgttgccgcagtacttgccacgctgatggtgagtcggggagtaggacagggatcatcaaccaccgtggttattttggcgggcgtggcggttgctgcttttgccagttccatccagacctatattcagcaacgacacatcgatacggtggcgcgcgtatatgtgtggatgttgggcaacctcaatgtcaccaactggatgtcgatcttcatcgtggctgtggtggcgggactatgcgcggccgtgatcatgtcctgcgccaggttgttagacgtgatggctgttggtgatgtggaagcccgcacattgggcgtcgatccaggcctcgtacgcattggcattgtcatcgtggcaacccttggtacagctgcagtggtatccatttccggtctcatcgggtttgtgggcatcattgttccgcacgccctgcgcctaattgttggcccggggcatcggattttactgccactgtctttcgtatggggtgccattttcctcgtgttggcagataccgcagggcgaacattgatggctcctcaggaacttcccgtgggtgtggtgacagctgcactcggcgcaccgttcttcttatttattttgcgcagaaccagcagacaacgagttccaaaaaggagtgcttaagtggcgatcattgaatgcga

SEQ ID NO: 484 - protein, 324 aa, Corynebacterium glutamicum
VVLFSGFSGVIDLSPTAVIRHLSGQDTLTPRDQAIFFDIRLPRIIAGVIVGATLAISGAAYQAVFRNPLADPYLLGVSAGSGLGVTAVIVGGTVLGFSAPSIGVIGAAFVGGVAAVLATLMVSRGVGQGSSTTVVILAGVAVAAFASSIQTYIQQRHIDTVARVYVWMLGNLNVTNWMSIFIVAVVAGLCAAVIMSCARLLDVMAVGDVEARTLGVDPGLVRIGIVIVATLGTAAVVSISGLIGFVGIIVPHALRLIVGPGHRILLPLSFVWGAIFLVLADTAGRTLMAPQELPVGVVTAALGAPFFLFILRRTSRQRVPKRSA

SEQ ID NO: 485 - DNA, 1197 bp, Corynebacterium glutamicum
  CDS (101)..(1174): RXN02794
gcgcccactcatcggcgagcttcaggagatgaggttgatgctccattgataatttctttcgctaatagtcaaatgatcatttgagtgttagtgttttctcatgcttctttccgcccgcacacacacgagtttccaagaacttggactcaatgctagtcggcgcaaagcaatcaactggacactggcactcactgtggtgctaattgcctccatgtttgttggcgtgctcatcggtgcatccgggacctcagtgttttccacgtggaccgtaattagccaccatctttttggcactgagctaggtggctccgacactgccgacgccatcatttggtacatccgcaccccacgcgtcttgctcgctgccattgtgggcgcaggccttgccctggcaggtgccatcatgcaagtactggtccgaaacatgctggcagacccctatatcctcggggtgaactcaggtgccagttgcggtgcggccgctgccttactgttcggagtgggcgctggatttggcgattacgccctccaaggcagcgcgtttctcggcgcaatggcagcttccggattgatcttcttcgtggcgcgcgcagcggggcgcatctcctcgacccgcttgttgatgtccggcgtagcgatcggatacatgctctctgcggcaacaagctttctcatcttctcctccgactccgccgaaggcagccgctccgtgttgttctggctgcttggatccttaggacttgccgcatggaatgggccgatggcgatcatcttcctcatcgtgggcattgccctggcgttgctcatggtgttgggtccgcaattggatgccttaaactccggcgatgaaaccgcacttaccttgggagtatcccctgatcgcctccgcattctcctcctggtgatcacctgcctgctggtgggatccatggttgccatggccggcagcatcggattcatcggccttgtcatcccccacctggccaggcgttttgttagtggaaaacaccgactcatgctgcctgtatccgcgttgatgggcgcaattttgctcatctgggctgatatcgccgcccgcaccctgcttgcgccccaagagattcccatcggcatcatcaccgcactcatcggagcacccttcctcctgattctggttcgccggatgcacacctactgatttttaaggaattatgcgta

SEQ ID NO: 486 - protein, 358 aa, Corynebacterium glutamicum
MLLSARTHTSFQELGLNASRRKAINWTLALTVVLIASMFVGVLIGASGTSVFSTWTVISHHLFGTELGGSDTADAIIWYIRTPRVLLAAIVGAGLALAGAIMQVLVRNMLADPYILGVNSGASCGAAAALLFGVGAGFGDYALQGSAFLGAMAASGLIFFVARAAGRISSTRLLMSGVAIGYMLSAATSFLIFSSDSAEGSRSVLFWLLGSLGLAAWNGPMAIIFLIVGIALALLMVLGPQLDALNSGDETALTLGVSPDRLRILLLVITCLLVGSMVAMAGSIGFIGLVIPHLARRFVSGKHRLMLPVSALMGAILLIWADIAARTLLAPQEIPIGIITALIGAPFLLILVRRMHTY

SEQ ID NO: 487 - DNA, 364 bp, Corynebacterium glutamicum
  CDS (101)..(364): FRXA01419
gcgcccactcatcggcgagcttcaggagatgaggttgatgctccattgataatttctttcgctaatagtcaaatgatcatttgagtgttagtgttttctcatgcttctttccgcccgcacacacacgagtttccaagaacttggactcaatgctagtcggcgcaaagcaatcaactggacactggcactcactgtggtgctaattgcctccatgtttgttggcgtgctcatcggtgcatccgggacctcagtgttttccacgtggaccgtaattagccaccatctttttggcactgagctaggtggctccgacactgccgacgccatcatttggtacatccgcaccccacgcgtcttgctcgct

SEQ ID NO: 488 - protein, 88 aa, Corynebacterium glutamicum
MLLSARTHTSFQELGLNASRRKAINWTLALTVVLIASMFVGVLIGASGTSVFSTWTVISHHLFGTELGGSDTADAIIWYIRTPRVLLA

SEQ ID NO: 489 - DNA, 744 bp, Corynebacterium glutamicum
  CDS (101)..(721): FRXA02794
tgaactcaggtgccagttgcggtgcggccgctgccttactgttcggagtgggcgctggatttggcgattacgccctccaagcagcgcgtttctcggcgcaatggcagcttccggattgatcttcttcgtggcgcgcgcagcggggcgcatctcctcgacccgcttgttgatgtccggcgtagcgatcggatacatgctctctgcggcaacaagctttctcatcttctcctccgactccgccgaaggcagccgctccgtgttgttctggctgcttggatccttaggacttgccgcatggaatgggccgatggcgatcatcttcctcatcgtgggcattgccctggcgttgctcatggtgttgggtccgcaattggatgccttaaactccggcgatgaaaccgcacttaccttgggagtatcccctgatcgcctccgcattctcctcctggtgatcacctgcctgctggtgggatccatggttgccatggccggcagcatcggattcatcggccttgtcatcccccacctggccaggcgttttgttagtggaaaacaccgactcatgctgcctgtatccgcgttgatgggcgcaattttgctcatctgggctgatatcgccgcccgcaccctgcttgcgccccaagagattcccatcggcatcatcaccgcactcatcggagcacccttcctcctgattctggttcgccggatgcacacctactgatttttaaggaattatgcgta

SEQ ID NO: 490 - protein, 207 aa, Corynebacterium glutamicum
MAASGLIFFVARAAGRISSTRLLMSGVAIGYMLSAATSFLIFSSDSAEGSRSVLFWLLGSLGLAAWNGPMAIIFLIVGIALALLMVLGPQLDALNSGDETALTLGVSPDRLRILLLVITCLLVGSMVAMAGSIGFIGLVIPHLARRFVSGKHRLMLPVSALMGAILLIWADIAARTLLAPQEIPIGIITALIGAPFLLILVRRMHTY

SEQ ID NO: 491 - DNA, 1140 bp, Corynebacterium glutamicum
  CDS (101)..(1117): RXN03079
gagcggggttgctatcggccgaaagtttagggttttgttcaatctgttggttagtattgcttgggtaaacaagtcataacaattttcattaagggtcgttttgtcgcgcacaggtgtttcgaaaaaaccaaagctcaccgctcctgttgtcatcatcggcaccctcgtcttgttgatcatcgccttcaccgcttccctcatgctgggtcccgtgacggttccattgaatgagcttgcaaccaaccccgttgtcaccgatatccgtgcaccacgcattatcatcgcagcattggtgggtgcggcgctggctgtctccggtgcgatcatgcagacggtgtttcacaacccgttggcggatcccggcattgtgggtgtgtcctccggtgcagctgttgcagctgtcttggcgattgtcaccggtgcgagtttctttggccaatggaccgttccttttgcggccttcgtgggcgcattggtcacggtggctgtggtatatttgatcgctagttcccgcgcgatggatggccgtggcgcagatccggccacgttggtactggtcggcatggctatcactgcctttttgggtgctgttatttccagcgccactgcgaacgcaccacaagattctgagcttcgatccgtgacgttttggctcaacggcgatctggtatctcggacgtgggaacatgtgggcgttgcaataatccccattatcgttgggttgattctagctatcggcggttcccgcgatctgaacttgttgctgctgggtgattccacagcgcaaacatctggactcaacgtcaaccgcgcacgcatcattttgctagcacttgcggcactgctcaccgccacagctgttgcggtctccggcaccattacgtttgttggattggtagtaccccacctggtgcgcattgttttaggtgccgatcaccgagcgttactcccggccgccgcgattttgggcgccacgtttgttatcgtttccgacactgttgcccgcatgatcttctcccccatcgtcttgcaaacaggcgtggtggtggcgttcattggctcaccaattttcctttatttactgctcagcatgcgcaagcgacgcggattggggctgtaaaaactcatgcctcaattagt

SEQ ID NO: 492 - protein, 339 aa, Corynebacterium glutamicum
LSRTGVSKKPKLTAPVVIIGTLVLLIIAFTASLMLGPVTVPLNELATNPVVTDIRAPRIIIAALVGAALAVSGAIMQTVFHNPLADPGIVGVSSGAAVAAVLAIVTGASFFGQWTVPFAAFVGALVTVAVVYLIASSRAMDGRGADPATLVLVGMAITAFLGAVISSATANAPQDSELRSVTFWLNGDLVSRTWEHVGVAIIPIIVGLILAIGGSRDLNLLLLGDSTAQTSGLNVNRARIILLALAALLTATAVAVSGTITFVGLVVPHLVRIVLGADHRALLPAAAILGATFVIVSDTVARMIFSPIVLQTGVVVAFIGSPIFLYLLLSMRKRRGLGL

SEQ ID NO: 493 - DNA, 1140 bp, Corynebacterium glutamicum; identical to SEQ ID NO: 491
  CDS (101)..(1117): FRXA02865

SEQ ID NO: 494 - protein, 339 aa, Corynebacterium glutamicum; identical to SEQ ID NO: 492

SEQ ID NO: 495 - DNA, 1695 bp, Corynebacterium glutamicum
  CDS (101)..(1672): RXA00181
gtatattcagacacccacgtcgattagtgttgtagttcacagtgcttattttttatttgtatctttgcacgtttgtcccctacccaaaaggagaaacctcatgagcgataacacctggttcatcatagccatcgttatctatatgttggtgatggtgctcatcggctattggagttaccgcaagacagaaaaatacgacgactacatgctcgccggccgcgggctcaacccttttgttgccgcaatgtccgcaggtgcctcagatatgtcaggttggctgctcatgggtctgcccggcgcgctgtttgtcaccggcatgtccgagttgtggatcgcagtcggactcaccattggtgcatgggcgaactggatgtgggtggcacctcgtcttcgttcttattccgaaatctcggccaactcaatcaccctgccttcattctttgagaaccgacttcgcgataaatctcgcgcgcttcgcatcattgcagcactaattatcattgtgttcttcaccttctacatttcttcaggcatggttgctggtggagtgtattgggagtccacgtttggtggagattatctactcggtatggccattgtcgcaggtgtgacagtgctgtataccttcattggaggattccttgctgtgtcttatacagacgcagttcaggggactatcatgttcttctcgttgatcatcgtgccagtcatggcatatttcgcactggcgaaccccatggatatttggagctttgcaaactctaatgattacggcccgcacaccgatggaattggcaatcccacctacttctccatgatcagtggcatttctgcagcagcaatcattggtaacttaggttggggtcttggatacttcggccagccacacattgtggttcgtttcatggcacttcgcacaccagctgaagcaaagcaaggtcgtcgcatcggtatttcctggatgataatctgcctgattggtgcaacctttaccgcaattatctccacagttttctttgcacaaaaccccgacgccaacatcactgacacaagggcttatgagtccatcttcctagatcttgcccggatgctgttccacccattgatcgctggacttattctgactgctgttctcgcggccatcatgtctaccatgtcgtcacagctgctggtcaccgcatcttccctgattgaggacctgctgaaggtagttaaaaaggactcgctgagcgaacgcaccctgatcatgctgtctcgtgccacagtcatcattctggcgatcattgcagcagccatggctattaacccgtctgattccatcctcggattggtgggatttgcgtgggcaggattcggctctgcatttggtccgatcatacttgctagcctttattggaagcgtctcaacgccgccggcgctatctccggcatgattactggtgctattgtctccatcgcgtggggtatgtccccactaagcgatacgttgtatgaaatcatcccaggtttcgccttggcaaccatcgtgatggtcgttgtttccctcctgacaaaggaaccctccgaagaaatcctcaacgagtttgaaaccgccaaggatcttgctgccgctgtggaatcaaacgaggatgttgatttcgctgacgcagctcagaagctttcgaaagaaagttaagccttagagggaaccaaacg

SEQ ID NO: 496 - protein, 524 aa, Corynebacterium glutamicum
MSDNTWFIIAIVIYMLVMVLIGYWSYRKTEKYDDYMLAGRGLNPFVAAMSAGASDMSGWLLMGLPGALFVTGMSELWIAVGLTIGAWANWMWVAPRLRSYSEISANSITLPSFFENRLRDKSRALRIIAALIIIVFFTFYISSGMVAGGVYWESTFGGDYLLGMAIVAGVTVLYTFIGGFLAVSYTDAVQGTIMFFSLIIVPVMAYFALANPMDIWSFANSNDYGPHTDGIGNPTYFSMISGISAAAIIGNLGWGLGYFGQPHIVVRFMALRTPAEAKQGRRIGISWMIICLIGATFTAIISTVFFAQNPDANITDTRAYESIFLDLARMLFHPLIAGLILTAVLAAIMSTMSSQLLVTASSLIEDLLKVVKKDSLSERTLIMLSRATVIILAIIAAAMAINPSDSILGLVGFAWAGFGSAFGPIILASLYWKRLNAAGAISGMITGAIVSIAWGMSPLSDTLYEIIPGFALATIVMVVVSLLTKEPSEEILNEFETAKDLAAAVESNEDVDFADAAQKLSKES

SEQ ID NO: 497 - DNA, 1476 bp, Corynebacterium glutamicum
  CDS (101)..(1453): RXA00591
gcaacgccacaggcaaaatccaaaagaacatcctgcgagacttcaccatccccgtttcataaaccccccaacgtcactttgaaaacacttggagaacgcaatgactacatcttccacagcttcgccgatcgctgaattacaaaacctcagcccgaagcaaagaaaatcagaatcccggcgcgcgattatatccagctacttgggctccacgatcgagttctatgacttcctgttatatgccgcagcctccgcgacggtattccccgcagtgttctttaccaatctcgatccgctggctggaaccattgccgcctacggaaccttcgccgcaggttatttagctaggccacttggtggagcaatcttcggacacttcggtgaccgtcttggacgcaagaagatgcttgtgttgtccatgctcatcatgggtgtggcatccacatgcatcggccttgtcccaagcgctgaaatgatcggaagcatgggcgcggtaatcctgatcatgctgcgcatctgccaaggcatcgctgtcggtggcgaatggggcggagctgccctcatggcgctcgagcactcagattccaagaagcgcggattcgccgcctccttcaccaacgctggtgcaccaaccggcgctgcactgggaaccttcgcgctcggtaccgcatctgctgttctcacccaggagcaattcctttcatggggttggcgcatcccattcctgctctctttcgttctgctgattgtcggcttggttatccgcgcgaaagttagcgaatcaccactgttcgcagctgcagcggccgccgaaaaagccaagccaaccgaacgtaaagtccccctcttgcaggttcttcgccgaccaaaggcactgatcttgaccatgcttggcggcgcatcaggattcggacttcaagttctcttgtccaccttctccatcagctacgcaacacaatccggcatcgaaagatccagcgtcctctacgccttcgcagtcgcctcagtgttctctgtcttctttgtgatcctcttcggtcgcgtatccgacctcttcggacgccgacccgtcatgatcatcgcgctcgtactgttcgtggcctacctgccggcattcttccggatgctcacctcagacaactggttcatcctgctctcggcattcaccatcgcgctcgcactccacgccatgctttacggcccactagcagcgtttatctccgaacaattcggaacctccgcgcgctacacaggcgcatccctgggttaccagttggccacgctcatcggtgcaggattcaccccaaccatcctggctagcctctacgcgggaccaggcggcggaacctctgtcaccccagtcatcgtcttcctcgcaacgatgtccctagtgtccatcatcgccatcgcaatcaccagagaatcaaaagaccacgatctttctacttacgaacactaaggggacgatagggtcaattt

SEQ ID NO: 498 - protein, 451 aa, Corynebacterium glutamicum
MTTSSTASPIAELQNLSPKQRKSESRRAIISSYLGSTIEFYDFLLYAAASATVFPAVFFTNLDPLAGTIAAYGTFAAGYLARPLGGAIFGHFGDRLGRKKMLVLSMLIMGVASTCIGLVPSAEMIGSMGAVILIMLRICQGIAVGGEWGGAALMALEHSDSKKRGFAASFTNAGAPTGAALGTFALGTASAVLTQEQFLSWGWRIPFLLSFVLLIVGLVIRAKVSESPLFAAAAAAEKAKPTERKVPLLQVLRRPKALILTMLGGASGFGLQVLLSTFSISYATQSGIERSSVLYAFAVASVFSVFFVILFGRVSDLFGRRPVMIIALVLFVAYLPAFFRMLTSDNWFILLSAFTIALALHAMLYGPLAAFISEQFGTSARYTGASLGYQLATLIGAGFTPTILASLYAGPGGGTSVTPVIVFLATMSLVSIIAIAITRESKDHDLSTYEH

SEQ ID NO: 499 - DNA, 1635 bp, Corynebacterium glutamicum
  CDS (101)..(1612): RXA01629
caggaagaagttaacaccgcccaggggtgcgttggatgatgatcatctacaaacaaacattccgttatgcactcataagatatgacgagaggttttactcgtgagcccgattcgctcaaaaaagaaaatcaagaacgaaccaagactaacagtcgatgacgtcaacgttgttcccccaaagaagatccgtccggccattaaaggcactgtggtgggtaacttcatggagtggtacgacttcggaatttatggttatttgacggtcacgatgaccgcagtatttacccaaggcctgccgcaagaatggcagttgttggccgtgatgtttggtttcgcggtgtcttatttagttcgcccgcttggtggcctggttctgggtccgcttggcgataaggttggccgccagaaggttttgtacgtaaccatggccatgatggccgtgtctacggcgctgattggcttgctgccgacggcggcgtcgataggcgcttgggctttggtgcttttgtacctgttgaagatggtgcagggattttcgactggtggtgaatatgctggtgcgaccacctatgttgctgagtttgcgccggatcgtcgacgaggtttcttcggagctttcctagatatgggttcctacctgggctttgccgcgggtgcttcggtcgtggcgattactacctgggtgaccactcacttctatggcgcaactgccatggaggatttcggttggcgtattcctttcctgactgcgatcccgctgggcatcattgcggtgtacctgcgtactcgtatccctgagacccctgcgtttgagaacaaccaagacgagccaaatgcagttgttgaaaaggacactgaagatccttatgcacgcctgggcctggctggtgttatccgccaccactggcgtccactgctgattggtattgcgattgtggcagcgaccaacaccgccggttacgcgctaaccagttacatgcctgtgtatctagaggagcagatcggtctgcactccgcatccgctgccgctgtgaccgtgccgattctggttgttatgtccctgctgctgccatttgttggtatgtggagtgaccgcgtgggccgcaagcctgtctacgcgactgctgttgcggcaacgctgatcttgatggttcctgccttcttgatcatgaacaccggaaccatcggcgccgtactgattgcactgtccatggttgctattccaaccggtttgtatgtggcactgtccgcatctgccctgccagcgctgttcccaaccgcgtcacgattctctggaatgggtatttcctacaacatttccgtgtcgttgttcggtggtacaaccccgctgatcacccagttcctgctgcagaagactggcctggatatcgttccagcgctctacatcatgttcttctctgcaatcgcaggtgtggcgctgctgttcatgaccgagtcttcacagaagccactgcttggctcattcccaaccgtggaaaccaagtctgaggccgtggagatcgtgaagaaccaggacgaggatccaaatattgatctttcccatatgccgtttcctgatgaggaaaacgtaggtgctgaaaagcaaaacgcataaccgtaaagcccgctgcaagg

SEQ ID NO: 500 - protein, 504 aa, Corynebacterium glutamicum
VSPIRSKKKIKNEPRLTVDDVNVVPPKKIRPAIKGTVVGNFMEWYDFGIYGYLTVTMTAVFTQGLPQEWQLLAVMFGFAVSYLVRPLGGLVLGPLGDKVGRQKVLYVTMAMMAVSTALIGLLPTAASIGAWALVLLYLLKMVQGFSTGGEYAGATTYVAEFAPDRRRGFFGAFLDMGSYLGFAAGASVVAITTWVTTHFYGATAMEDFGWRIPFLTAIPLGIIAVYLRTRIPETPAFENNQDEPNAVVEKDTEDPYARLGLAGVIRHHWRPLLIGIAIVAATNTAGYALTSYMPVYLEEQIGLHSASAAAVTVPILVVMSLLLPFVGMWSDRVGRKPVYATAVAATLILMVPAFLIMNTGTIGAVLIALSMVAIPTGLYVALSASALPALFPTASRFSGMGISYNISVSLFGGTTPLITQFLLQKTGLDIVPALYIMFFSAIAGVALLFMTESSQKPLLGSFPTVETKSEAVEIVKNQDEDPNIDLSHMPFPDEENVGAEKQNA

SEQ ID NO: 501 - DNA, 1509 bp, Corynebacterium glutamicum
  CDS (101)..(1486): RXA02030
gcgcctaacatctcattgtatgggattgactctaataatctcctgtggaaacatcgcaagggtaattattggaatctattattgtgtgaggcgataactcgtgaccacaactgatcactccacggagttgaatccttctgatccaggtgggcagacggcaaccctagtgattgacaagaaaactaaacgtcgggttgcagcagcctccaccatcggcacaaccatcgagttctacgatttttatgcgtacgctgcggcagctgtcgttgttttcccaagtctgtttttccctgccaatgacaacccaaccgtgaacctgttggcatcgtttgccacctttggtcttgcgttcgttgctcgtccactcggttcaatcattttcgggcacttcggtgaccgtgtgggacgcaaagctaccttgatcggttcactgctgaccatgggcattgccaccatcttgatcggcctgctgcctacttatggtcaggtcggaatcattgcaccggcgctgttggcgctcatgcgtttctgccagggcctgggccttggcggtgaatggtctggcgctgcgttgctggctggtgaaaacgcggaaaacactcaccgcgctcgtgctgcaatgtggccacagctgggtgcaccgtttggtttcttcttggccaatggtttcatgctcattctggtcggtgtgcttgcccatcaggacggcgatcttcacggcgcgttcatgacctggggttggcgtctgccattcctgtcttcggcgatcatgatcgcagttggcctgtgggtgcgtttctcactggaggaaactccagtgttcaagcaggctgttgatcagggcaagaaggtgaagtctccgctcaaggagctgttcaagacttcccctggccctgttgtgcaggctactttgatcatgctgtccacttataccttgttctacctggttaccacgtggattctgtcgtatggcatcggtaatcgcagcaccggaaacggcctgtctattccgtactttgagttcttgcagttgcagctggccaccatcgtgttcttcgccatcatgatccctgtgtcaggctggttggctgatgtgtggggtcgtaaaaacaccctgaccttggcttctgtgctgcttctcggctttggtctgacgtttaatctgcttctcgatccagagaccgccaccaagaccaccgtgttcatcttcttgttcgtgggcatgagcatcatgggtctgatctttggacccatgtcggcaattttgccggagctcttccccaccaacgtccgctacacgggctccggaatcgcctacaatgtctcctcgatcctcggtgcagctattgcaccgttcatcgcaacgtggctggtgtccgagttttcagtggcgtacgtcggctattacctcatcatcgtcaccgcaattacctttgttgcggtgctgacgatgaaggaaaacaaaaaccacgacctccgagaggtctaaaagatttttgcttatcgacg

SEQ ID NO: 502 - protein, 462 aa, Corynebacterium glutamicum
VTTTDHSTELNPSDPGGQTATLVIDKKTKRRVAAASTIGTTIEFYDFYAYAAAAVVVFPSLFFPANDNPTVNLLASFATFGLAFVARPLGSIIFGHFGDRVGRKATLIGSLLTMGIATILIGLLPTYGQVGIIAPALLALMRFCQGLGLGGEWSGAALLAGENAENTHRARAAMWPQLGAPFGFFLANGFMLILVGVLAHQDGDLHGAFMTWGWRLPFLSSAIMIAVGLWVRFSLEETPVFKQAVDQGKKVKSPLKELFKTSPGPVVQATLIMLSTYTLFYLVTTWILSYGIGNRSTGNGLSIPYFEFLQLQLATIVFFAIMIPVSGWLADVWGRKNTLTLASVLLLGFGLTFNLLLDPETATKTTVFIFLFVGMSIMGLIFGPMSAILPELFPTNVRYTGSGIAYNVSSILGAAIAPFIATWLVSEFSVAYVGYYLIIVTAITFVAVLTMKENKNHDLREV

SEQ ID NO: 503 - DNA, 870 bp, Corynebacterium glutamicum
  CDS (101)..(847): RXA00186
agaagcccagcattttgtttagctcacctctaaagctcctgatctggatacgaggactcctgcggaaaaccgtgtggctagtgaagctacccggcatctcatgggggagaagacttctgtcgcgtatgttcacgatgttctgatcaagggcgtgccagtgcggatatacaatccgcaccccaacgacgggccgcttcctgtctttatctacttccatggtggcggatgggttttgggggaccttgaatcagtggattccaccgtgcgcgatattgccgttgcttcaggcgccctgtgtatcagtgtggattatcgccgtgcaccggaacatccttttctcgctgcattggatgattgccaagtggtcacggaagctgtcctcaatggtgaactcgccagtgctaaccagcatctagtggcagtcggcggggacagcgccggtggcaatattgcggcggtcatcgctcaacagctgcgcgatcagatcacccaccaagttcttgtgtatccggtgatggacgtaatcttgctggtgatttgttctatcattaccactggttttgcgctgctcatgcatccaaagagcaaggacaagacggagacgatttctgatgaattcctcgcagagatccaagcgggaagtgaaaagatctccattctgcgttcgacccctgctgaaaaagccaatgcgagccgttggatcatgtacttcgttggcggaattggcctgctctacagcgtgttcagcctgtggacaggtggcgtaaccggactgacgttgaactccttcaacttcctgttcctgtcactcggcatggtgctcaccgctaattacgggccagagtattaagcaaagcttattcgcgaagg

SEQ ID NO: 504 - protein, 249 aa, Corynebacterium glutamicum
MGEKTSVAYVHDVLIKGVPVRIYNPHPNDGPLPVFIYFHGGGWVLGDLESVDSTVRDIAVASGALCISVDYRRAPEHPFLAALDDCQVVTEAVLNGELASANQHLVAVGGDSAGGNIAAVIAQQLRDQITHQVLVYPVMDVILLVICSIITTGFALLMHPKSKDKTETISDEFLAEIQAGSEKISILRSTPAEKANASRWIMYFVGGIGLLYSVFSLWTGGVTGLTLNSFNFLFLSLGMVLTANYGPEY

SEQ ID NO: 505 - DNA, 468 bp, Corynebacterium glutamicum
  CDS (101)..(451): RXA00187
gcttattcgcgaaggcatccaaggaacgtggggattcattcttcaattcccgttctacgcaggcattttcgggttgatttccttcaccggtctgggtgttgtgatctccggatttttcacctcgatttccacggcaaccacgtggcctgtcatcgcgttcctctactctggactgctcaacatcgcggtgccttcaggtggctcgaaattcatcatcgaagccccgtacatcatcccaaccccagtggatcttggcgctgacatgggccttgtcctgcaggcttatcaaatgagtgatggcgcgaccaacctgctcattccgttcttcgcgctgccatatttggccaatttcaagatcaaattcagccaagtggtgggctatacagttccgcctgtcctcgttgttatcgccgtgatctgcatttacctgttcctgcgagcatcaatcatttaaaaagatgcttctcg

SEQ ID NO: 506 - protein, 117 aa, Corynebacterium glutamicum
VISGFFTSISTATTWPVIAFLYSGLLNIAVPSGGSKFIIEAPYIIPTPVDLGADMGLVLQAYQMSDGATNLLIPFFALPYLANFKIKFSQVVGYTVPPVLVVIAVICIYLFLRASII

SEQ ID NO: 507 - DNA, 1329 bp, Corynebacterium glutamicum
  CDS (101)..(1306): RXA01667
tctcggcgttgatgatcatccgcaatatcatgccgccgcaagattccgcttttccagactttgctcattccttcctctattactgctcgccatcatcggcatgattttggggcctaaggtgttgggtctgattggttggtcggatcatctttccacttacactacggtgctcattgcgattgtgtttgcttcgatgccgtattcgatgaagtttgaccgtggcgtgcgtactggcatgaagacgatgtgggcgtattcgactgcgatgtttgtggggcagtggggtctgttcattttgctgggtctgtttttgttccaaccggtgtggggtaccgatgagtggttcggcatgatgttgccggttggttttgttggtggttttggtactgctgctgcggtgggtactgcgttggagtcttcgggtgcggaggctgcgatgtctttgggctttacctctgcgacggtgggtacttttgctgcgattgttggtggaattattttcacaacgtggggtattaagaagggcaagactgcggcgatgcctgcgcagttgccgtgggatttgcgttcgggttatatcgataagctgagtgatcgtccgtcgattggtaaggcgagtacgaatccgtctgcgattgagcctttggcgctgcatactggcattattttgttgactgttgcggttgcgtattccattaatcagtggttgggtagcatgttcccaaccgtgcagattccgttgtttgcgatgtcatttgtggtcggcattgtgggcatgggaattatgcgtttgttgaagaagcctgagtatttggatcgcgacaccgtgaattccgtgtcgggcgcggcgacggattacctcattgcgtttggtattgcctcgattgctcctgctgcgattgctgattactgggttcctcttgtggtgctgtttgttttgggcaccatcaactgttgtttcttctttttctgggttgcgcctcgtttctttggcgagaagtggctggagcgcgcgatcttcggttggggttgggctactgccgcggttgctaccggtatcgcgttgctgaagatcgtggatccgaagttgaagtcgggagcgcttaatgagtacggcgtggcttatatcggttttgctccatttgaaatcggcatgaccatcatcgcgccgatcgcggtgctcgcaggctttaccatggggttgggttgggcgtcgttgattgttgcgatcgtgatttttggcctcgcgtggggtctgaagtggttgccggagcgcggacatgtccgcggcgagggtaagccgcaataaaggttggaagcgccgggtct

SEQ ID NO: 508 - protein, 402 aa, Corynebacterium glutamicum
MILGPKVLGLIGWSDHLSTYTTVLIAIVFASMPYSMKFDRGVRTGMKTMWAYSTAMFVGQWGLFILLGLFLFQPVWGTDEWFGMMLPVGFVGGFGTAAAVGTALESSGAEAAMSLGFTSATVGTFAAIVGGIIFTTWGIKKGKTAAMPAQLPWDLRSGYIDKLSDRPSIGKASTNPSAIEPLALHTGIILLTVAVAYSINQWLGSMFPTVQIPLFAMSFVVGIVGMGIMRLLKKPEYLDRDTVNSVSGAATDYLIAFGIASIAPAAIADYWVPLVVLFVLGTINCCFFFFWVAPRFFGEKWLERAIFGWGWATAAVATGIALLKIVDPKLKSGALNEYGVAYIGFAPFEIGMTIIAPIAVLAGFTMGLGWASLIVAIVIFGLAWGLKWLPERGHVRGEGKPQ

SEQ ID NO: 509 - DNA, 1776 bp, Corynebacterium glutamicum
  CDS (101)..(1753): RXA02171
aaccacattcgtcattacttacatctatgtcatgtttgcgaacaagaacttggagcctcgtcaggctgctattcgccagaagatggaaggttaatcagatatgaattccactattctccttgcacaagacgctgtttctgagggcgtcggtaatccgattcttaacatcagtgtcttcgtcgtcttcattattgtgacgatgaccgtggtgcttcgcgtgggcaagagcaccagcgaatccaccgacttctacaccggtggtgcttccttctccggaacccagaacggtctggctatcgcaggtgactacctgtctgcagcgtccttcctcggaatcgttggtgcaatttcactcaacggttacgacggattcctttactccatcggcttcttcgtcgcatggcttgttgcactgctgctcgtggcagagccacttcgtaacgtgggccgcttcaccatggctgacgtgctgtccttccgactgcgtcagaaaccagtccgcgtcgctgcggcctgcggtaccctcgcggttaccctcttttacttgatcgctcagatggctggtgcaggttcgcttgtgtccgttctgctggacatccacgagttcaagtggcaggcagttgttgtcggtatcgttggcattgtcatgatcgcctacgttcttcttggcggtatgaagggcaccacatacgttcagatgattaaggcagttctgctggtcggtggcgttgccattatgaccgttctgaccttcgtcaaggtgtctggtggcctgaccacccttttaaatgacgctgttgagaagcacgccgcttcagattacgctgccaccaaggggtacgatccaacccagatcctggagcctggtctgcagtacggtgcaactctgaccactcagctggacttcatttccttggctctcgctctgtgtcttggaaccgctggtctgccacacgttctgatgcgcttctacaccgttcctaccgccaaggaagcacgtaagtctgtgacctgggctatcgtcctcattggtgcgttctacctgatgaccctggtccttggttacggcgctgcggcactggtcggtccagaccgcgtcattgccgcaccaggtgctgctaatgctgctgctcctctgctggccttcgagcttggtggttccatcttcatggcgctgatttccgcagttgcgttcgctaccgttctcgccgtggtcgcaggtcttgcaattaccgcatccgctgctgttggtcacgacatctacaacgctgttatccgcaacggtcagtccaccgaagcggagcaggtccgagtatcccgcatcaccgttgtcgtcattggcctgatttccattgtcctgggaattcttgcaatgacccagaacgttgcgttcctcgtggccctggccttcgcagttgcagcatccgctaacctgccaaccatcctgtactccctgtactggaagaagttcaacaccaccggcgctgtggccgctatctacaccggtctcatctccgcgctgctgctgatcttcctgtccccagcagtctccggtaatgacagcgcaatggttccaggtgcagactgggcaatcttcccactgaagaacccaggcctcgtctccatcccactggcattcatcgctggttggatcggcactttggttggcaagccagacaacatggatgatcttgctgccgaaatggaagttcgttccctcaccggtgtcggtgttgaaaaggctgttgatcactaaatctagtttctgaagttatt

SEQ ID NO: 510 - protein, 551 aa, Corynebacterium glutamicum
MNSTILLAQDAVSEGVGNPILNISVFVVFIIVTMTVVLRVGKSTSESTDFYTGGASFSGTQNGLAIAGDYLSAASFLGIVGAISLNGYDGFLYSIGFFVAWLVALLLVAEPLRNVGRFTMADVLSFRLRQKPVRVAAACGTLAVTLFYLIAQMAGAGSLVSVLLDIHEFKWQAVVVGIVGIVMIAYVLLGGMKGTTYVQMIKAVLLVGGVAIMTVLTFVKVSGGLTTLLNDAVEKHAASDYAATKGYDPTQILEPGLQYGATLTTQLDFISLALALCLGTAGLPHVLMRFYTVPTAKEARKSVTWAIVLIGAFYLMTLVLGYGAAALVGPDRVIAAPGAANAAAPLLAFELGGSIFMALISAVAFATVLAVVAGLAITASAAVGHDIYNAVIRNGQSTEAEQVRVSRITVVVIGLISIVLGILAMTQNVAFLVALAFAVAASANLPTILYSLYWKKFNTTGAVAAIYTGLISALLLIFLSPAVSGNDSAMVPGADWAIFPLKNPGLVSIPLAFIAGWIGTLVGKPDNMDDLAAEMEVRSLTGVGVEKAVDH

SEQ ID NO: 511 - DNA, 1333 bp, Corynebacterium glutamicum
  CDS (101)..(1333): RXA00902
ttgttattggtttgttcactcccatgcaatgtacgatcggttctaacgtctacggcaattgacacgtcaatttaattcaggaaaggggtggggagaatttatgtctagtggttttgaatatgttcaacatcctcgacgagccctccctccgcctatacctgaacggaaaggtcctgccgcagcattcctgccgggaactttccatcccattaatccaaagaatattgcagcgagccacgatcaggtgcttctatctggttggggcaaatttgtgcgttggctcttggtattgttgtccattttggtcatcatcattggcatcaacctcatcttggacggtgtctacggatttggtactttttcaaccacccagatgtaccaagttgcgaaagatccactcattggtgtgctgatcggtatcttggctacggccttggtgcaatcatcaaccaccaccacaacgttgacggtgactgcagttggtacgggcattgtgtcggtgcctgtggcgattccgatcattcttggcgcaaatatcggtacgacgatcaccgcgatgctcgttgcgttttcttatgtgggtgaacgcagggagtttaagcgagcttttacggttgccgccatgcatgtgtggtttaacgtgctcgtcattcttgttctatttgttgtggaattgctctttcatccattccgcacaattagtggtgcgatcgcaacggagatcacactgacaactggtggctctttgcctaccagtggtgtgatgaccaagatttttgatcccccaacccaacttctgggtatgaatggtcttatcggttcgatcggcaatcctagtatttcggcgattgtatgtcttgtggtgggcaccattcttattctgatttcggtgcgtgccatgagttctcagatccgaaccattacggcagcgaccgtaacctcaattatggacaaggtgatcaatccagagaacagccccaaggcgacgattctttccaatttctggagcttcattcttggagttttgttcacgctcatggtcactgcctcgtcagtgaccgtggcttccatgcagccagtggctgcctctggtgtcgttaagcaaaagccattgctgggcgtcattttgggtgccaacgtgggcaccacggtgaccgcaatgtttgctactttcgcgattgtcagcgatcagggtgagttcgctattcaggctgcgttgatccacctcattgtgaacttcaccggcgcattactagtgctgtgtattccgcagcttgccaatgtgattattcacttggccgagaaaactgcgaacctcactgcccgcagttac

SEQ ID NO: 512 - protein, 411 aa, Corynebacterium glutamicum
MSSGFEYVQHPRRALPPPIPERKGPAAAFLPGTFHPINPKNIAASHDQVLLSGWGKFVRWLLVLLSILVIIIGINLILDGVYGFGTFSTTQMYQVAKDPLIGVLIGILATALVQSSTTTTTLTVTAVGTGIVSVPVAIPIILGANIGTTITAMLVAFSYVGERREFKRAFTVAAMHVWFNVLVILVLFVVELLFHPFRTISGAIATEITLTTGGSLPTSGVMTKIFDPPTQLLGMNGLIGSIGNPSISAIVCLVVGTILILISVRAMSSQIRTITAATVTSIMDKVINPENSPKATILSNFWSFILGVLFTLMVTASSVTVASMQPVAASGVVKQKPLLGVILGANVGTTVTAMFATFAIVSDQGEFAIQAALIHLIVNFTGALLVLCIPQLANVIIHLAEKTANLTARSY

SEQ ID NO: 513 - DNA, 1440 bp, Corynebacterium glutamicum
  CDS (101)..(1417): RXA00941
agccggggtggccgtttgcgtgtacgggttttgcttatcgacgcccacttctgattttaaaggcaaatattttgtgtcacagcgagtaatcttttcgggcatgaacctaacccggaatgacaggctcgatcgactgcccgtaacttccaaacataaaaagattcttggcggctcaggtatcggctgggcattggatgccatggatgtcggactgatctctttcgtcatggctgcgttggccactcattggggcctatcccctactgaaacttccctgctcggatccatcggtttcgttggcatggccatcggcgcttcgctgggcggtttgctggcggacaagttggggcgtcgacaagtttttgcgttgtctttgctagtttatggcgttgccactggcgcgtcggcgctttcagtgtcgctggcaatgttgatggcgctgcgcttcgtcgttggacttggcctgggcgctgaactccccgttgcatccactctgatttccgagttttctccacgaaaagttcgtggccgcatggtcgttatcctggaggcgttttgggcgctgggctggatcatggctgcaatcgtcggaacctttgtcgtggcaggatccgataatggttggcgttgggcgttagctcttggctgtgtccctgcaatttacgcggtgtatgtccgtctcggacttccagaatcagtacgtttcctggagaagaaaggccggcacgacgaagcagaagccatcgttgtttccttcgaagaagctgccgctgccgaaggtaaagctgccgatgccaccaccgctgtggttcatgacaacgctgccgagggttccgtatccatctggtcagctgctttgcgcaagcgcaccgtcgcgctgtggatcgtgtggttctgcatcaacttgtcctactacggagccttcatttggattccatcgctgctggttgccgacggtttcaccctcgtgaagtctttccaattcactctgatcatcaccttggctcagcttccaggctatgcggttgcagcgtggttgattgaaaagtggggccgtcgcagcacattggccacgttcctggttggttctgctatctctgcagcgctctacggcttggcaaatgtggagtggcagatcctggtcgcaggttgtttactatccttcttcaacctgggcgcatggggcgcactgtatgccattgggccggagctttatcccactaatgtccgtggaactggaacgggtgctgccgcgggattcgggcgcattgcttccatcatcgctccgctcattgttccgccagtgattgcttttggtggaccaattgctttgttcgctctctttgccaccgcgtttgcgatcgcagcgattgcggcgtttacgctgcctgagcagaagggtaagtctctcgctgattagtgagatccttccaccagttt

SEQ ID NO: 514 - protein, 439 aa, Corynebacterium glutamicum
MNLTRNDRLDRLPVTSKHKKILGGSGIGWALDAMDVGLISFVMAALATHWGLSPTETSLLGSIGFVGMAIGASLGGLLADKLGRRQVFALSLLVYGVATGASALSVSLAMLMALRFVVGLGLGAELPVASTLISEFSPRKVRGRMVVILEAFWALGWIMAAIVGTFVVAGSDNGWRWALALGCVPAIYAVYVRLGLPESVRFLEKKGRHDEAEAIVVSFEEAAAAEGKAADATTAVVHDNAAEGSVSIWSAALRKRTVALWIVWFCINLSYYGAFIWIPSLLVADGFTLVKSFQFTLIITLAQLPGYAVAAWLIEKWGRRSTLATFLVGSAISAALYGLANVEWQILVAGCLLSFFNLGAWGALYAIGPELYPTNVRGTGTGAAAGFGRIASIIAPLIVPPVIAFGGPIALFALFATAFAIAAIAAFTLPEQKGKSLAD

SEQ ID NO: 515 - DNA, 1704 bp, Corynebacterium glutamicum
  CDS (101)..(1681): RXN00449
tcgttggcttacatggtcattgatgaccgggctgaatatgtgagaaaatccatcccttctttaagcaagggagtgaattacagaaaaggattgttcagcaatgagcacacctgacattaaagaaggctcggcagaatcaccgggcgaagtaatggtcgttggagacaggcgagagtggcgtcgacaagcaaccggcatcattgccggcctcgtcttagccgccctggtctatcttctcttcccctcgaactccgtggaaaccgtcatgcaatccagtggcgtcgatccagaaactgaatacaccaacaacgcgatgcgtcttactgctgcagtcacaatcttgatggcagtgtggtggatgacagaagcaatcccactagcagcaaccgcacttatcccgttggttgcattccctgctttccaggttgtggactttgggaaggcaacagctccgtatgccaaccctacgagcttcctcttcttgggcggctttcttatggcacttggcctgcagaaatggaacctacaccgacgtatggctctagcggtcgtgctagctgttggtactaagccaaagcaattggtcttgggttttatggtggcaactggatttttgtccatgtgggtgtctaacactgcaacggccgtggttatgttaccgatcggtatgtcggtactggcactgaccgctgagactgtgggcggaatgaaaaaccaaaagaaattcgccactggactcatgctgtccattgcttattctgcttccatcggttcactcggcaccttaattggcacgccacccaatgccttgcttgctgcgtatatgtctgaatcgcatgatatccacatcggatttggtcagtggatgattcttggtgtaccaattgctgtcgtcttcaccatcatcgcgtggcttgtgttgaccaccgtgttcaagccagaaatgaaagaaatccctggcggacgtgaactgatcaaacgtgaaatcgctgaaatggggccgtggactgcacctcaggtcacagtgggtgttatttttgcggcagctgcactggcttgggtcttcattccattaactctagattggaccggttcccagctctctatcaatgactccctcattggcatcgctgccggcctgctgatgtttatcgttcccgctaactttaaaaccggcgaacgcattcttgattggcgtactgcaggcgaacttccatgggatgttctcttgctttttggtggcgggctttcactttctgcgatgtttaccagcacgggactttccctatggatcggtgaactagctaagggacttgatgcccttccaatcttcattctcatcttcgccattgctgtcctggtgttgttcctgaccgagttcacctccaacaccgcaacagcggcaaccttcctgccaatcatgggtggcgtcgccgtaggtatcggactgaccgcaggtggcgagcagaatgttctgctgctgaccatcccagtcgcactgtccgcaacctgtgcgttcatgcttccagtggcaacgcctccaaacgcgattgcattcggctccggctacattaagatcggcgaaatggtcaagggtggtctgtggctgaacatcatcgcagtcatcctcattacgattttcacctacttcgtagcgatcccactctttggcatcatgctttaaaagttaacaggcccgcagtc

SEQ ID NO: 516 - protein, 527 aa, Corynebacterium glutamicum
MSTPDIKEGSAESPGEVMVVGDRREWRRQATGIIAGLVLAALVYLLFPSNSVETVMQSSGVDPETEYTNNAMRLTAAVTILMAVWWMTEAIPLAATALIPLVAFPAFQVVDFGKATAPYANPTSFLFLGGFLMALGLQKWNLHRRMALAVVLAVGTKPKQLVLGFMVATGFLSMWVSNTATAVVMLPIGMSVLALTAETVGGMKNQKKFATGLMLSIAYSASIGSLGTLIGTPPNALLAAYMSESHDIHIGFGQWMILGVPIAVVFTIIAWLVLTTVFKPEMKEIPGGRELIKREIAEMGPWTAPQVTVGVIFAAAALAWVFIPLTLDWTGSQLSINDSLIGIAAGLLMFIVPANFKTGERILDWRTAGELPWDVLLLFGGGLSLSAMFTSTGLSLWIGELAKGLDALPIFILIFAIAVLVLFLTEFTSNTATAATFLPIMGGVAVGIGLTAGGEQNVLLLTIPVALSATCAFMLPVATPPNAIAFGSGYIKIGEMVKGGLWLNIIAVILITIFTYFVAIPLFGIML

SEQ ID NO: 517 - DNA, 1028 bp, Corynebacterium glutamicum
  CDS (1)..(1005): FRXA00449
ctggcactgaccgctgagactgtgggcggaatgaaaaaccaaaagaaattcgccactggactcatgctgtccattgcttattctgcttccatcggttcactcggcaccttaattggcacgccacccaatgccttgcttgctgcgtatatgtctgaatcgcatgatatccacatcggatttggtcagtggatgattcttggtgtaccaattgctgtcgtcttcaccatcatcgcgtggcttgtgttgaccaccgtgttcaagccagaaatgaaagaaatccctggcggacgtgaactgatcaaacgtgaaatcgctgaaatggggccgtggactgcacctcaggtcacagtgggtgttatttttgcggcagctgcactggcttgggtcttcattccattaactctagattggaccggttcccagctctctatcaatgactccctcattggcatcgctgccggcctgctgatgtttatcgttcccgctaactttaaaaccggcgaacgcattcttgattggcgtactgcaggcgaacttccatgggatgttctcttgctttttggtggcgggctttcactttctgcgatgtttaccagcacgggactttccctatggatcggtgaactagctaagggacttgatgcccttccaatcttcattctcatcttcgccattgctgtcctggtgttgttcctgaccgagttcacctccaacaccgcaacagcggcaaccttcctgccaatcatgggtggcgtcgccgtaggtatcggactgaccgcaggtggcgagcagaatgttctgctgctgaccatcccagtcgcactgtccgcaacctgtgcgttcatgcttccagtggcaacgcctccaaacgcgattgcattcggctccggctacattaagatcggcgaaatggtcaagggtggtctgtggctgaacatcatcgcagtcatcctcattacgattttcacctacttcgtagcgatcccactctttggcatcatgctttaaaagttaacaggcccgcagtc

SEQ ID NO: 518 - protein, 335 aa, Corynebacterium glutamicum
LALTAETVGGMKNQKKFATGLMLSIAYSASIGSLGTLIGTPPNALLAAYMSESHDIHIGFGQWMILGVPIAVVFTIIAWLVLTTVFKPEMKEIPGGRELIKREIAEMGPWTAPQVTVGVIFAAAALAWVFIPLTLDWTGSQLSINDSLIGIAAGLLMFIVPANFKTGERILDWRTAGELPWDVLLLFGGGLSLSAMFTSTGLSLWIGELAKGLDALPIFILIFAIAVLVLFLTEFTSNTATAATFLPIMGGVAVGIGLTAGGEQNVLLLTIPVALSATCAFMLPVATPPNAIAFGSGYIKIGEMVKGGLWLNIIAVILITIFTYFVAIPLFGIML

SEQ ID NO: 519 - DNA, 448 bp, Corynebacterium glutamicum
  CDS (101)..(448): FRXA01755
tcgttggcttacatggtcattgatgaccgggctgaatatgtgagaaaatccatcccttctttaagcaagggagtgaattacagaaaaggattgttcagcaatgagcacacctgacattaaagaaggctcggcagaatcaccgggcgaagtaatggtcgttggagacaggcgagagtggcgtcgacaagcaaccggcatcattgccggcctcgtcttagccgccctggtctatcttctcttcccctcgaactccgtggaaaccgtcatgcaatccagtggcgtcgatccagaaactgaatacaccaacaacgcgatgcgtcttactgctgcagtcacaatcttgatggcagtgtggtggatgacagaagcaatcccactagcagcaaccgcacttatcccgttggttgcattccctgctttccaggttgtggactttgggaaggcagca

SEQ ID NO: 520 - protein, 116 aa, Corynebacterium glutamicum
MSTPDIKEGSAESPGEVMVVGDRREWRRQATGIIAGLVLAALVYLLFPSNSVETVMQSSGVDPETEYTNNAMRLTAAVTILMAVWWMTEAIPLAATALIPLVAFPAFQVVDFGKAA

SEQ ID NO: 521 - DNA, 912 bp, Corynebacterium glutamicum
  CDS (101)..(889): RXA00269
tgcgatcttggtggttgtcgccatgctgctgccgaggtggcgtgcgaagttctccaaggcaccgaagcctaagcaaccagtagcagtggaggcttaagacatgttatccatcaacggaatttctaagacgttcttccccggcactgtgaatgagcgccgcgcgttgcagcagctcaaactcgatatggctgagggcgattttgtcaccgtcatcggttctaacggtgcgggtaaatccacgctgctcaacgctgtttctggccgtttgcttgttgattccggcgagatttccatcgacggcaacaaggtaaacaagatgtcagagcacaagcgtgcccgctacatcggccgcgttttccaggatcctctggccggcaccgcgccgaatctcaccattgaagagaatctggccatcgcgttgctgcgcggcaagcgccgtggattgggctttgcactgacctcgaagcgccgtgagcaattcaagcaggaacttgagcgccttgagctgggtctggaaaacaggctcactgccaaagttggtttgctctctggcggtcagcgtcaggcattgtccctgctgatggctggttttactcaacctaaaatcatgctgttggatgagcacaccgcagcgcttgatccacagcgtgcagagcttgtgaccaccttgaccgaaaagatcgtggcagatggaaatctgactacgcttatggtcacgcacaacatggaacaggcaattcgcctgggcaatcgcctgatcatgatgcatgaaggccagattgtctaccaggcagatcaggctaccaagtcgaagttgactgtgcgcgatttgctgcaggagttcgccaacatcaagggcgcaacattgtctgacaaggcgttcctcggctaaaaagagcttgctttacgacg

SEQ ID NO: 522 - protein, 263 aa, Corynebacterium glutamicum
MLSINGISKTFFPGTVNERRALQQLKLDMAEGDFVTVIGSNGAGKSTLLNAVSGRLLVDSGEISIDGNKVNKMSEHKRARYIGRVFQDPLAGTAPNLTIEENLAIALLRGKRRGLGFALTSKRREQFKQELERLELGLENRLTAKVGLLSGGQRQALSLLMAGFTQPKIMLLDEHTAALDPQRAELVTTLTEKIVADGNLTTLMVTHNMEQAIRLGNRLIMMHEGQIVYQADQATKSKLTVRDLLQEFANIKGATLSDKAFLG

SEQ ID NO: 523 - DNA, 817 bp, Corynebacterium glutamicum
  CDS (101)..(817): RXA00369
ggcgggaaattacaatcaggcatcggcgttgtcgttgatgtttgcgattatcggtatcgtggcgctcgcgttgacggtgcgcagccagaaggagttttaggtgtcatcgatcaaattgcgcgatttaagcgtgagcttccgcgacggaaccttcgggctgcaagatatcaatttgaaaattgagccggaagaatttgtggtgctcatcgggccgtcggggtccggtaaaaccaccatgttgggcaccatcgcggggtttgtggagccaagttccggcagtgtgctcatcgccggcgaagaaatgacgcatgtcccgccggagcgccgtcgcatgggcatggtgtttcagcagcatgcggtgtggccgcatatgtcggtcgccaagaatgtgggatacccgctggcgcgaagtggtcagaagggggcgtcgataagcaaacgcgtggagcgcacgctcgcgctggtggggcttgaggggttcggcagtcgcagaccggccagcctgtctggtggtcaacgtcagcgggtggcgcttgcgcgcgccatcatcgccgaccccaccgtgctgcttctcgacgaggccctctccgccctcgacgaaccgctgcgagacgctttacgacgcgaactcgtatctttgacccggcgcgaaggcctcactactgtgcacgtgacgcatgaccgcgccgaagcgatctccatcgctgaccgcatcgtcgtactcggcaacggtcgaatccaacaggtagccacccctactgagctcctttccgcccccgctactgccgatgttgcccgattcatcgtcgacgccacc

SEQ ID NO: 524 - protein, 239 aa, Corynebacterium glutamicum
VSSIKLRDLSVSFRDGTFGLQDINLKIEPEEFVVLIGPSGSGKTTMLGTIAGFVEPSSGSVLIAGEEMTHVPPERRRMGMVFQQHAVWPHMSVAKNVGYPLARSGQKGASISKRVERTLALVGLEGFGSRRPASLSGGQRQRVALARAIIADPTVLLLDEALSALDEPLRDALRRELVSLTRREGLTTVHVTHDRAEAISIADRIVVLGNGRIQQVATPTELLSAPATADVARFIVDAT

SEQ ID NO: 525 - DNA, 1653 bp, Corynebacterium glutamicum
  CDS (101)..(1630): RXA02073
tcattgttttagaggatggccaattgaccatgatggatacacccagcaacgtttcccagcacaatgcgtttttccgcaccgctgtgatggaggaagaacaatgatttcccgacttctccaattggctaagaaagtatggccggaacttggagcctccacgctcctgcgactgctcaatcagctactcaccgcagcactcattgtgttccccgcctgggtgctaagccgcaaaccagacatctccctgctcgccgtcgccatcatcatggcgctcatcgcgctgacagcagctgtctgtcgctggggtgagcaggtatgcggccaccgcgctgcctttgggctgcttgcccacatgcgcgttatgctttacgacgccctcgtccacaaaggttccccctcgccgatccacggcagcggttcgatcatgtctgttgccacccgtgacattaactccatcgaagtattcttcgcgcacaccattgggcctacagtcaccgcagtgctgctcagtgcgggaggcgtgatcacgctggcaacgctcgatcccgttgctggtctaattggtttactcggtgtcctcatcgcgtggttgatccccttgattggaaaacaatcctcaagcagtgaagccacatcacgtggacacatcgcccagcacctcaccgaagatgccgccggcaggcttgaaatcaactcacatggagcgcaagccacacggttaaatgcgctcgaggtgaaagagcaacaactggaacaagttgtgacccgacagggcttgatcgtcggtatccgtcagggcgcagcacttttatggccgtggatatcagctgtgttgttggttgctctggttcctcatgtgggcattgttgcagccgcgattatcctgggcatctcccctgcgttggatgcagttgagggatttgctcgcaccatgcctaccgcgttaaacagtgcgcagcggtatttccagatcatcgatgcccctgttgctatcgctgaacctgacgagccgaagcctttgcccaaaggcccgcttaagctgcgaatttctagagttccagtcagcgcaaagggcaccgtgtctttagaggttgcagctggtgaacacatcggcatcatcggatccagcggtagtggaaaatccactttggccaaactcatcctcaagctggcgcaactacggtctggaaccatcaccatcggtggtgttgatatcgcagaggtttcatcggcggagcttcgcaaatccgtcacgctggttgagcagaaatctgtgctgtttagagcaagcgtgctggagaatttacggatgggcaatccagagctgtctgaagatgaagcaagggaagccttgaggttggcgtcgataagcgaactgcctttagatgctgacgccctgcgcctatctggcggacagcaacaacggctctgcctggcgcgtgctttggcacgcacccctcaggtactgattgtcgatgaagccaccagccaccaagatgcgctcaatcaagcggatctttcccagactctggccacgcttaaagacaccacggtgatcatcattgcgcaccgcacagctgcattaacccatgtggatcggataattgacctggaagaaatcaaaaatccctgatccttaacgcggatcagggg

SEQ ID NO: 526 - protein, 510 aa, Corynebacterium glutamicum
MISRLLQLAKKVWPELGASTLLRLLNQLLTAALIVFPAWVLSRKPDISLLAVAIIMALIALTAAVCRWGEQVCGHRAAFGLLAHMRVMLYDALVHKGSPSPIHGSGSIMSVATRDINSIEVFFAHTIGPTVTAVLLSAGGVITLATLDPVAGLIGLLGVLIAWLIPLIGKQSSSSEATSRGHIAQHLTEDAAGRLEINSHGAQATRLNALEVKEQQLEQVVTRQGLIVGIRQGAALLWPWISAVLLVALVPHVGIVAAAIILGISPALDAVEGFARTMPTALNSAQRYFQIIDAPVAIAEPDEPKPLPKGPLKLRISRVPVSAKGTVSLEVAAGEHIGIIGSSGSGKSTLAKLILKLAQLRSGTITIGGVDIAEVSSAELRKSVTLVEQKSVLFRASVLENLRMGNPELSEDEAREALRLASISELPLDADALRLSGGQQQRLCLARALARTPQVLIVDEATSHQDALNQADLSQTLATLKDTTVIIIAHRTAALTHVDRIIDLEEIKNP

SEQ ID NO: 527 - DNA, 1142 bp, Corynebacterium glutamicum
  CDS (1)..(1119): RXA01399
attctcagccccgcaaccgcacttgtcctggcgattggattgattgctgctgcaattatccctcccctgcttgctgctcgcggagttaaaacagccgaagcccggcgcgctgaatccagcgaagcctacttgagttccttggatcaggtgctgtccaaccaggcggcgcttcgtgttcgtggtgaaatgccggccgctctgtccaaggcggatgtggctgcgcgttcctattcttcttcactggaggcaggcgcgaaagacactgccattggcgcagcgagttccctgtggattcacggtttcactgtcattggtgtgctcatggtttccgcgtcactgtatgcagatggaagccattcaccgcagtggtttggtgtgttggtgctgctttcactcgcagctttcgaggctgtctctgttctccccgatgctgcgattgctcgtacccgcgccgcagatgccaccaggaggcttgcggaaatctcggcgctgccagaatctgtctctcttgagcttcgcacggcctctgaccagcccgtattacgcgccgagaatctagtttatggatgggacagcgacctaggcacgagcaacctggatctcacctttggttcacgacatgaaatcatcgcaccctctggaactggcaaaacgaccctgctgctcacacttgcggggctgttggaacctcgtggaggccaagtgcttatcgacggcaccaatccttccgagttgaaaaacgccgtgctgttcagtccagaagatgcccacatttttgccaccactgtccgagataacttagcactcggagcaccggaagcaaccgacgcggaaatgacatcgatcctggaacatgttggtttgtcagagtgggttcaaggtttacccgatggtcttggcactgtccttgattcaggtgccgatagtctctcgggaggtcagcgccgccgcctgctccttgcccgcgtactactaagtgatgcaccaattctgcttttggatgaacccaccgagcacctcgacactgcaggctcctctgaaatcttgtctatgctggcctccgatgaactccctggtaaaagagctaggagaaccgtagtgattgtgaggcatgtgaggtaattttgccccgctgtcttctg

SEQ ID NO: 528 - protein, 373 aa, Corynebacterium glutamicum
ILSPATALVLAIGLIAAAIIPPLLAARGVKTAEARRAESSEAYLSSLDQVLSNQAALRVRGEMPAALSKADVAARSYSSSLEAGAKDTAIGAASSLWIHGFTVIGVLMVSASLYADGSHSPQWFGVLVLLSLAAFEAVSVLPDAAIARTRAADATRRLAEISALPESVSLELRTASDQPVLRAENLVYGWDSDLGTSNLDLTFGSRHEIIAPSGTGKTTLLLTLAGLLEPRGGQVLIDGTNPSELKNAVLFSPEDAHIFATTVRDNLALGAPEATDAEMTSILEHVGLSEWVQGLPDGLGTVLDSGADSLSGGQRRRLLLARVLLSDAPILLLDEPTEHLDTAGSSEILSMLASDELPGKRARRTVVIVRHVR

SEQ ID NO: 529 - DNA, 1368 bp, Corynebacterium glutamicum
  CDS (101)..(1345): RXA01339
gagaaggcggaaccgaaggaatcgaagaatatctctccgtgcgttacctcgctttgccgtgacacatgagctgtccggtgaataacccgaaggaaaaaacatgactaccgaatcaatagttgcgcacaatgctgcaggtacagcacctcagaatgtgtcctctgctaagaagaagtacctcagcgttgcccaaggcgttgcccttatctacggaaccaacatcggcgccggtgtgctcagcctcccatacgctgcccgcaacggtggtttcctcgccctggttgttgccctgctcattgcgggaacactgaccaccatctccatgctctacatcgccgaagtatccctgcgcaccaagaagccactgcagctttccggcctggcagaaaaatacctggggcagtggggccgctggctggtgttcattgccattgtggtcaacagcgtgggtgcactgattgcctacgcatcaggatccggcattttgataggcaacctcaccggcctgccaccaatcgtgggcacccttggattctttgttttaggcaccttgatcatgtggaaaggcctgcacacggcaagcttcgtggaggcattgatcaccactggcatggcaacgatcatcatcgtgctgtgtggatggacagtgcttggccctggaatttccgcagacaacctgatcgtgttccacccattcttcatcgttccgatcatgaacctcgcggtctttaccttccttgcccaatatgtggttccagaaatcgcacgaggagttaaccctgccaccccgaaggcagtgccacgcgcgatcatcatcggcatggtcgcaactggtgtcaccctggcagctgtaccattcgcggcactagggcttctgggcacaggcgtcagtgaagttgtcaccatctcctggggcgaagcactcgccccagtggcctattacatggccaatgccttcgcactattggccatgttcacttcattcatcgccattggattcaccgcgatgcgcaacgtactagatattggccactggccacaacacggatggcagcgatccgttgctgtcggactaactgttcttccaccactggcaatttcacttgcgggattaggcggattcgtggcagcactgagctacgccggaggatttgccggagcaatcatgtccatcatccccgtgctgttgctgcgcaactcccgcaagagtggcgaccaagaaccagtgtggaaagccacctggcaagcgcaccccatcttccagatcctgttgattgtggtgtactccctggcgtttgtgtactcggttctcgcgatcgtcggattaatgcctgcgggttgggcatagtcacttcctgttgtggctgc

SEQ ID NO: 530 - protein, 415 aa, Corynebacterium glutamicum
MTTESIVAHNAAGTAPQNVSSAKKKYLSVAQGVALIYGTNIGAGVLSLPYAARNGGFLALVVALLIAGTLTTISMLYIAEVSLRTKKPLQLSGLAEKYLGQWGRWLVFIAIVVNSVGALIAYASGSGILIGNLTGLPPIVGTLGFFVLGTLIMWKGLHTASFVEALITTGMATIIIVLCGWTVLGPGISADNLIVFHPFFIVPIMNLAVFTFLAQYVVPEIARGVNPATPKAVPRAIIIGMVATGVTLAAVPFAALGLLGTGVSEVVTISWGEALAPVAYYMANAFALLAMFTSFIAIGFTAMRNVLDIGHWPQHGWQRSVAVGLTVLPPLAISLAGLGGFVAALSYAGGFAGAIMSIIPVLLLRNSRKSGDQEPVWKATWQAHPIFQILLIVVYSLAFVYSVLAIVGLMPAGWA

SEQ ID NO: 531 - DNA, 1452 bp, Corynebacterium glutamicum
  CDS (101)..(1429): RXA02527
attggagcaatcttttaatcaagttgggaattccagcgttgattgtggttgccatgtggtttgcccgcaccctgaagcactcacggatcaagcgtggcggatgtttggcctgttcatcgcgacgattgtggcgattattctcaagccaatgccaatgggtgccgtgacaattatcggcatgatcgccgcggtgttgactggtttggtgccgttgacggcgtcttctgatgatcccggcgcggtgtatggccttattggtttcagtaacggcaccatttggctgattgtgatggcgttcctgatttcgcgtggattcatcaagacggggcttggacgtcgaatagcgttgttctttgtgtctaaagtcggcggaaaaatgctgggtgtgacctatggtttggcgctcgctgatttggtgttggctcctgcgattccatcagcaactgcccgaggtggtggcattatggctccgattatgaagtcggtggcattgacttatgattccactcctggcccaactcgtcgcagggctggcgcgttcttggcgctgaatgtgggacaggtaaatgcgattacgtgcgcgatgtttctaactgcaatggcaggaaaccccttgatcgcctctttggcttcgcagatggatgtcaatatcacgtggacaaactgggctgtgggtgcgattgtgcctggtctggtggcgcttattgtggtgccgtgggtggtatacaagatctatccacctgagttgaaggacacccctgaggtcaagaaaatggcttctgatgagctcaagcaattgggtgggtttacttatggtgagaaggtgctggcgggaacctttgttgtgttgctgctgctctggacaggtggcgatttggtcttgggaatctcggcaactaccaccgctttcgttggcgtcatcatcttgctagtggctcacgtgctgacgtgggaggacatcattcaagaaaagactgcgtgggacaccatggtgtggttcgcggtgctatacatgatggcaacagcgttatcgcagtacggattcatcgcatggatctctgaggtaattgcttccagtttgggtggcatgaactgggtcgttgctttggttgtgttggtgctgatttacttcttcagtcactatttctttgcctcggcaacagcgcatatttctgcgatgtacttggccttcctgggtgctgcgattgcgattggtgcacccccgttgatggcggccctggtgttggcgtacacctccaatttgttctcttcactcactcagtattctggtggtccttcgccaacattgtttggtttgaactacatcacggtgggtgagtggtggcggacctcggcaattgctggcgcggtatcgattacaatctggttggttatcggtggtttgtggatgaatgtcatcggactctggtaatcgaaaattaaaggtaaggg

SEQ ID NO: 532 - protein, 443 aa, Corynebacterium glutamicum
MFGLFIATIVAIILKPMPMGAVTIIGMIAAVLTGLVPLTASSDDPGAVYGLIGFSNGTIWLIVMAFLISRGFIKTGLGRRIALFFVSKVGGKMLGVTYGLALADLVLAPAIPSATARGGGIMAPIMKSVALTYDSTPGPTRRRAGAFLALNVGQVNAITCAMFLTAMAGNPLIASLASQMDVNITWTNWAVGAIVPGLVALIVVPWVVYKIYPPELKDTPEVKKMASDELKQLGGFTYGEKVLAGTFVVLLLLWTGGDLVLGISATTTAFVGVIILLVAHVLTWEDIIQEKTAWDTMVWFAVLYMMATALSQYGFIAWISEVIASSLGGMNWVVALVVLVLIYFFSHYFFASATAHISAMYLAFLGAAIAIGAPPLMAALVLAYTSNLFSSLTQYSGGPSPTLFGLNYITVGEWWRTSAIAGAVSITIWLVIGGLWMNVIGLW

SEQ ID NO: 533 - DNA, 1968 bp, Corynebacterium glutamicum
  CDS (101)..(1945): RXN00298
tttagacaagttctggttaaaattcttcatgaaggtgagaatctgggaatttctcggtactctttcagattcgtagttatccactgattggaagaatgagatgagctcaaatatagctatcacgaccgagcctgaagggaaaaataaaaagggtctcaaatcagacccgttcattttttccatttctgtcggttttatcgtggtgtttgtcatcgccacaattgcgctaggcgagaaagctcgaacaaccttttccgcgattgccggctggctcttagaaaatttagggtggatgtatatcgggggtgtctccttggttttcattttcctcatgggtatctttgcgtcccggtatggccgggtaaaacttggtgatgacgatgatgaccccgagcacaccctaatcgtgtggttctgtatgctttttgctggcggtgtcggtgcagtcttaatgttttggggtgttgccgaaccgattaaccacgcgttcaacgtgccaatggctaatgaagaatccatgagtgaagccgcaattgtgcaggcttttgcttatactttctatcacttcggtattcacatgtgggtaatcatggcactcccaggattatcattgggatactttatttacaaacgtaagctacctccccgtctatcctctgtgttttctccgatcttgggtaagcacatttattccacacccggcaagctcatcgatgtactggccatcgtaggcaccacgtttggtattgctgtgtcagtaggtcttggtgtgctgcaaatcaatgcaggtatgaacaaactatggagcaccccgcaagtatcgtgggttcagcttttgatcatcttgatcatcaccgcggttgcatgtatttccgttgcttccggtttggataagggcattaagttactgtccaacattaatattgcaatggccgttgcgttgatgttcttcatcttgttcactggtccaaccctcacattgctgcgctttctcgtagaatccttcggaatctatgcatcctggatgcctaatctgatgttttggactgactctttccaagataacccaggctggcagggcaaatggacggtgttctattgggcatggactatttgttggtcgccatatgtcggcatgttcgtggcgcgtatttcgcgtggacgtaccgtccgtgaatttatcggtggggttctagctctgccagcgatctttggcgtagtttggttctctatctttggtcgtgcaggcatcgaagtggaactgagtaacccaggtttcttgacccagccaactgttgttgaaggtgacgtgccagcagcgctttttaatgtgctgcaagagtatccgctgactggaattgtctccgcgtttgcacttgtaattattgtgattttctttatcacctccatcgattccgcagcgctagttaacgatatgttcgctaccggtgcagaaaatcaaacaccgactagttaccgcgtgatgtgggcctgcaccattggggcggtcgcaggttccttgctgatcatttccccatcctctggtattgccacgctgcaagaagtggttatcatcgtggctttcccattcttcctcgtgcaatttgtcatgatgttttctttgcttaaaggcatgagtgaagatgctgctgcggttcgtcgtgtgcagactcgtcagtgggaaaagactgatacaccagaaaaacttgaagagcattcgtcccaaccagccccgggctatgatgacgagggcaaccccttgccaatgcctgccctcgaacatgatgaggacggtaacattgttatcccaggcaacgtagtcattgaaggtgatcttggggtagttggtgatgtggtcgacgatcctgaggaagcccaagagatggggtctcgttttaagatcgtcgagcaaactcggccccagtccagggacgaatacgatatttaaacgattgcttttcgacgcac

SEQ ID NO: 534 - protein, 615 aa, Corynebacterium glutamicum
MSSNIAITTEPEGKNKKGLKSDPFIFSISVGFIVVFVIATIALGEKARTTFSAIAGWLLENLGWMYIGGVSLVFIFLMGIFASRYGRVKLGDDDDDPEHTLIVWFCMLFAGGVGAVLMFWGVAEPINHAFNVPMANEESMSEAAIVQAFAYTFYHFGIHMWVIMALPGLSLGYFIYKRKLPPRLSSVFSPILGKHIYSTPGKLIDVLAIVGTTFGIAVSVGLGVLQINAGMNKLWSTPQVSWVQLLIILIITAVACISVASGLDKGIKLLSNINIAMAVALMFFILFTGPTLTLLRFLVESFGIYASWMPNLMFWTDSFQDNPGWQGKWTVFYWAWTICWSPYVGMFVARISRGRTVREFIGGVLALPAIFGVVWFSIFGRAGIEVELSNPGFLTQPTVVEGDVPAALFNVLQEYPLTGIVSAFALVIIVIFFITSIDSAALVNDMFATGAENQTPTSYRVMWACTIGAVAGSLLIISPSSGIATLQEVVIIVAFPFFLVQFVMMFSLLKGMSEDAAAVRRVQTRQWEKTDTPEKLEEHSSQPAPGYDDEGNPLPMPALEHDEDGNIVIPGNVVIEGDLGVVGDVVDDPEEAQEMGSRFKIVEQTRPQSRDEYDI

SEQ ID NO: 535 - DNA, 1968 bp, Corynebacterium glutamicum; identical to SEQ ID NO: 533
  CDS (101)..(1945): FRXA00298

SEQ ID NO: 536 - protein, 615 aa, Corynebacterium glutamicum; identical to SEQ ID NO: 534

SEQ ID NO: 537 - DNA, 576 bp, Corynebacterium glutamicum
  CDS (101)..(553): RXA00596
ccgccaccgacggcctcttgaacaccgatgcataccaacaggctgtgctcggtgaaaatgccatcggagtgccaagccctagctaccagggaggaaactaatgcttaacgccctgaaattcatcccatggctgatcggccagattttcctctctggcttcagcgtgatcaccgctgcggtaaaaaaggacaccggcttcaaccccgttgttatccgctacccacttcgagtgaccacggacttccagatcgcagccctgtcaacgtgcatcaccgcgactccttccaccctgtcccttggcctacgcgaaccccgcaagcccggcgaccccaccattttgctgatccaagcagtgtttggttccgatccagtagaagtttttgaatccatcgccgatatggaacaacgcctcgtcccttcggtcgcttcaattgaccacggcgtcccaggccaaggcccttacaaggagatccgccccagcgatgctgagtggccaagtcgcgagatcgctgacaccgcccaaaacaccgtcagccaagacaagagggagttttaaaacaacatgactgcttttgg

SEQ ID NO: 538 - protein, 151 aa, Corynebacterium glutamicum
MLNALKFIPWLIGQIFLSGFSVITAAVKKDTGFNPVVIRYPLRVTTDFQIAALSTCITATPSTLSLGLREPRKPGDPTILLIQAVFGSDPVEVFESIADMEQRLVPSVASIDHGVPGQGPYKEIRPSDAEWPSREIADTAQNTVSQDKREF

SEQ ID NO: 539 - DNA, 750 bp, Corynebacterium glutamicum
  CDS (101)..(727): RXA02364
gcgaaagtatctaaggtcgtttgattggtttactacccccgaagtgggggttattggcagcatcgagcaccaaatgagcgtgatccgggatcaggatctgatggagccactgttccaaagtcttgcggaatcggacaatatttctgtcattggtggatttacccaaggcacccgaaatctgtacaccactgatgcgccggtgaaaagacccgctgacctggctggaaagaagattcgcgtccaggaatccgccatgcacatccgcatgattgaactcatgggtggctcggcaaccccgttgacttacggcgaggtatataccgcgatgcagtctggtgtgctggatggcgcggaaaataacgagatcagttacgttacccaaaaccacttcgaggttgctcgctacaacagcaacaccaatcaccttgtcggtttggattacatggtcatgcgacacgatctgcttgacgccatgagcgagccagaccgtgaattgttcctggaagaatgggacgccgcgatgactgagcacacggatctgtggaacacagaaactgatgccgttattgaaaaggcgaaagctgggggagcggagttcgttgaggtggatgcgcaagcatttaccgatgcactggctcccatcaaagacgaattcttgacctcagaattccagcgtgaactctacgaagcagtgcgcgccgctgatacttcaggaggtgcggcatcatgatgaattttaagtccatcgtg

SEQ ID NO: 540 - protein, 209 aa, Corynebacterium glutamicum
MEPLFQSLAESDNISVIGGFTQGTRNLYTTDAPVKRPADLAGKKIRVQESAMHIRMIELMGGSATPLTYGEVYTAMQSGVLDGAENNEISYVTQNHFEVARYNSNTNHLVGLDYMVMRHDLLDAMSEPDRELFLEEWDAAMTEHTDLWNTETDAVIEKAKAGGAEFVEVDAQAFTDALAPIKDEFLTSEFQRELYEAVRAADTSGGAAS

SEQ ID NO: 541 - DNA, 888 bp, Corynebacterium glutamicum
  CDS (101)..(865): RXN01411
cttatcgacgtccccatccccctcgccaatgcttcggcgaggggttctatttattgtgtgtgctagccttttcgcaatcgttcagcccgccccgacgtcaatgttgggagtgggctggcgcattccattcctgatggccgtgccactagggcttatcggctggtggatccgcaccggtgcccaggaaaatgtacgccccgcatccgaacgccccgaagctcctattaagcaggcattgcgtactgagtggaagatgatgttgcgggtaggtggctttatctcttgcaccggtctgagcttctacattttcaccacgtacatgaccactttcctgcgcagcaccgtcggactggagggcacgttagtgctggctggaaacatcatcgctctcagcatggcagcaattgtggccccatttgttggccgcgcaattgataaattcccccgccggaacatcatggctttcgctaccttaagcacagtaattatggcgatcccggcctacatcattgcaggtcaaggtactttgactgcttctttgattgcgcaggtaatgcttggaatcggcgcggttaccgctaactgcgttacctcagtaatgatggccgaggtcttccaagaggtcacccgcggtacttccgccggcattacctacaacgtcacttacgcaatcttcggcggctcggctccatttatctccaccgcattggtctcctggaccggcagcccgctggcccctgcggtatacatgatcatcattgcgctcttcgccttcaccgcgtcccgcttcattcctgaaacctccccagtttttgtcaccgcaaccccggccattaaggcaccaaaggtgctggtcaacccgggttaaaccacgcttttcgacgaaaa

SEQ ID NO: 542 - protein, 255 aa, Corynebacterium glutamicum
MLGVGWRIPFLMAVPLGLIGWWIRTGAQENVRPASERPEAPIKQALRTEWKMMLRVGGFISCTGLSFYIFTTYMTTFLRSTVGLEGTLVLAGNIIALSMAAIVAPFVGRAIDKFPRRNIMAFATLSTVIMAIPAYIIAGQGTLTASLIAQVMLGIGAVTANCVTSVMMAEVFQEVTRGTSAGITYNVTYAIFGGSAPFISTALVSWTGSPLAPAVYMIIIALFAFTASRFIPETSPVFVTATPAIKAPKVLVNPG

SEQ ID NO: 543 - DNA, 1058 bp, Corynebacterium glutamicum
  CDS (1)..(1035): RXN00960
atggctcggcattgttgcagcaatcgctacgcgtccaccgtcttctccggtctgatcgcctacggagcatcccaagcgctctacccatggctgctgaaagaccaccaaagcgtcaccgaaatcgaccttgatgcaggtgccctccagccctacttcaacatcgagatgccaccaccatttgaagtgatgaccgcactgctgctggcattctgcctcggcctgggcatggctgtaattaaatcagacaccctgttcaaggtaacccgcgaactcgagcgcgtagtcatgaagaccatcaccgcctttgtcatcccactgctgccactcttcatcttcggcatcttcctcggcatgggcatgaacggtggcctcctggagatcatgtccgcctttggcaaggtactgattctcgccgtcgtgggaaccctgctcttcctagccatccagttcattatcgctggtgcagtatccaagaagaacccatggaaactgttcaaaaacatgctccctgcatacttcactgcactgggcacttcctcttcagcggcaaccatcccagtgacctaccagcagaccctgaaaaacgatgttgatgtcaacgtcgcaggctttgttgtcccactgtgcgccaccatccacctagctggatcgatgatgaagatcggcctcttcaccttcgctgttgtcttcatgtacgacatggaagtaggcgtcggcctctccatcggattcctcctcatgctgggcatcaccatgatcgccgcaccaggcgttcccggcggagccatcatggcagcaaccggcatgctggcctccatgctcggattcaacaccgaacaagtcgccctcatgatcgccgcttacatcgcgattgactccttcggcaccgcagcaaacgtcaccggcgacggcgcaatcgcagtcatcgtgaacaaattcgccaagggccagctgcacaccacttccccagatgaaatcgaagaagacgaccgcgttgccttcgacatcactccatcggatgtggaacatcacaagtagaaacccgcattttctgtagt

SEQ ID NO: 544 - protein, 345 aa, Corynebacterium glutamicum
MARHCCSNRYASTVFSGLIAYGASQALYPWLLKDHQSVTEIDLDAGALQPYFNIEMPPPFEVMTALLLAFCLGLGMAVIKSDTLFKVTRELERVVMKTITAFVIPLLPLFIFGIFLGMGMNGGLLEIMSAFGKVLILAVVGTLLFLAIQFIIAGAVSKKNPWKLFKNMLPAYFTALGTSSSAATIPVTYQQTLKNDVDVNVAGFVVPLCATIHLAGSMMKIGLFTFAVVFMYDMEVGVGLSIGFLLMLGITMIAAPGVPGGAIMAATGMLASMLGFNTEQVALMIAAYIAIDSFGTAANVTGDGAIAVIVNKFAKGQLHTTSPDEIEEDDRVAFDITPSDVEHHK

SEQ ID NO: 545 - DNA, 1118 bp, Corynebacterium glutamicum
  CDS (1)..(1095): RXN02447
acagtagttccggtgtacctcgctgaactcgcaccactagaaatccgcggctccctgaccggccgaaacgagcttgctatcgtcaccggccagctgcttgccttcgtgatcaacgcgcttatcgccgtcaccctacacggagttattgatggaatctggcgcatcatgttcgccgtctgtgccctccctgccgtcgccctcttcctcggcatgctgcggatgccggaatcaccacgctggctggtcaaccaggggcgttacgacgacgcccgccgcgtcatggagaccgtccgtacccctgagcgtgcgaaagccgaaatggatgaaatcatcgcggtgcactctgaaaacaatgcggcacttcctggtgttaagcagtcttcgggccaggcttcaggccaggtttctagcaagcacacccacatgtccatcggcgaagtcctcagcaacaaatggctggttcgtctgctcatcgccggcatcggtgttgcagttgcccagcagctcaccggcatcaacgccatcatgtactacggaacccgcgtcctcgaggaatccggcatgagcgcagaaatggctgtggttgccaacattgctttcggtgccgttgccgtcatcggtggactgatcgcactgcgcaacatggaccgcctggatcgccgcaccaccttcatcatcggcctgtcactgaccaccaccttccaccttttgatcgcagctgccggcactctccttccagaaggtaactccattcgaccattcgccatcatgatccttgttgttgggttcgtgctctccatgcagactttcctcaacgttgcagtgtgggtgtggctggcggaaatcttcccagtccgaatgaagggtatcggcaccggtatttcggtattctgcggttggggcatcaatggcgtcctagcgttgttcttcccagcactggtctccggcgtgggtatcaccttctccttccttatcttcgcagtcgtcggagtcattgccctggcgttcgtcaccaagtttgttcctgaaacccgtggccgctcacttgaagaactcgatcacgcagcattcaccggccagatcttcaagaaggcttaaaccccctccgatctctttgg

SEQ ID NO: 546 - protein, 365 aa, Corynebacterium glutamicum
TVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 547 - DNA, 2013 bp, Corynebacterium glutamicum
  CDS (101)..(1990): RXN02395
aaacaggaatatttaactcgacttcttaaaaaagctctatacgtaaatatcttgcccatccagcaccacctcattgtggtgcacaatggagaggacacacatgtccaccaactctggcaataacttgcctgaatcccaagagtcacccgaggaacctcattatcctcacgacacccacccaggcctagttcctggcatttcggtcgatgctcaacgcaacaagttcggactcgacaaaaccgttttcggcgtcaccgcagcattaattctggcgttcatcgcctggggcatttccagccctgattcggtttcttcagtatcgtccacgatgttcagttgggctatgacgaatactggttggctcctcaactttgtcatgctgatcggcattggcaccatgctctacatcgctttttcgcgctacggccgcatcaagctgggcacggacgaagacgaaccagaattctctcgcttttcctggattgcgatgatgttcggcgccggcatcggtgtcggtatcttcttcttcggtccttccgaaccgctgtggcattatctcagtcccccacctcacaccgtggaaggatctacacctgagtccttgcaccaagcacttgcgcagtcccacttccactggggcttatccgcctgggggctgtatgccttggtcggcggcgcgttggcgtactccagttaccgacgcggccgcgtaaccttgatcagctccaccttccggtcacttttcggtgagaaaaccgaaggtatcgcgggtcgcctcatcgacatgatggcgatcatcgccacgctgtttggaacggctgcaaccttgggcctttcagcaattcaggttggtcagggcgtgcagattatttctggcgcttcggaaatcaccaacaacatcttgatcgccatcatcgcgatcttgaccattggcttcatcatctcctcagtatctggcgtgtccaagggcattcgttatctttccaacctcaatatttccttgacgcttggattggtcctgtttgtgttcatcaccggccccaccttgttcctgctcaacttgatcccatcgagtgtgttggaatatggcagtgagttcttgtcaatggctggcaagtctttgtcgtggggtgaggaaaccattgaattccaagctggttggacggcgttctactgggcatggtggatcgcatggactccattcgtgggtatgttcatcgcgcgtatttctcgcggccgcaccttgcgtgaattcgcgctcatcaccatggctatcccctccttcattttgatcctggcgttcaccattttcggtggaactgccatcacgatgaaccgcgagaacgtagatggttttgacggcagttcatccaaggaacaggtgctgtttgatatgttcagcaaccttccgctgtactcgatcacaccgttcattttgatctttgtgctggcagtattctttgttacctctgccgattccgcctccgtggtgatgggaacgatgagctcccaaggtaaccctgcaccaaacaaattaatcgtggtgttctggggactgtgcatgatgggcatcgcggtggtcatgctgcttactggtggcgaatccgcgctgactggtctgcagaacctcaccattttgatcgccattccgtttgcgctggtgttgatcgtgatggctattgcctttattaaggacttatccacagacccagccgctattcgacaacgctatgcaaaggcagccatctctaacgcggtggttcgtggcttggaagaacacggcgacgacttcgagctctccatcgaacctgcagaggaaggtcgtggagcgggtgctaccttcgattccaccgctgatcacatcaccgactggtatcagcgcaccgacgaagaaggcaatgatgttgattatgacttcaccaccggcaaatgggccgatggttggacaccggaatcgaccgaagaaggcgaagtggacgcgaaaaaggattaaaaaataacgactggctggga

SEQ ID NO: 548 - protein, 630 aa, Corynebacterium glutamicum
MSTNSGNNLPESQESPEEPHYPHDTHPGLVPGISVDAQRNKFGLDKTVFGVTAALILAFIAWGISSPDSVSSVSSTMFSWAMTNTGWLLNFVMLIGIGTMLYIAFSRYGRIKLGTDEDEPEFSRFSWIAMMFGAGIGVGIFFFGPSEPLWHYLSPPPHTVEGSTPESLHQALAQSHFHWGLSAWGLYALVGGALAYSSYRRGRVTLISSTFRSLFGEKTEGIAGRLIDMMAIIATLFGTAATLGLSAIQVGQGVQIISGASEITNNILIAIIAILTIGFIISSVSGVSKGIRYLSNLNISLTLGLVLFVFITGPTLFLLNLIPSSVLEYGSEFLSMAGKSLSWGEETIEFQAGWTAFYWAWWIAWTPFVGMFIARISRGRTLREFALITMAIPSFILILAFTIFGGTAITMNRENVDGFDGSSSKEQVLFDMFSNLPLYSITPFILIFVLAVFFVTSADSASVVMGTMSSQGNPAPNKLIVVFWGLCMMGIAVVMLLTGGESALTGLQNLTILIAIPFALVLIVMAIAFIKDLSTDPAAIRQRYAKAAISNAVVRGLEEHGDDFELSIEPAEEGRGAGATFDSTADHITDWYQRTDEEGNDVDYDFTTGKWADGWTPESTEEGEVDAKKD

SEQ ID NO: 549 - DNA, 2007 bp, Corynebacterium glutamicum
  CDS (101)..(1984): RXN02348
aaagacccgagccgaagccctggcctgcgcatacttccttgtcaacgctcgctgggattaggtcttttctgagcgctagcatttctccactcaaaggagcatgcttaaccgcatgaaaagtgcgcggccaaaatcagtcgctccaaaatccggacaagctttactcactctcggtgccctaggtgttgtgttcggcgacatcggcaccagccccctgtactcacttcacactgcattcagcatgcagcacaacaaagtcgaagtcactcaggaaaatgtgtacggcatcatctccatggtgttgtggaccatcactttgatcgtcaccgtcaaatacgtcatgctggtcacccgagctgacaaccaaggacaaggtggcatcctggcgctcgttgctttgctgaaaaaccgtgggcactggggaaaattcgtggcagtagccggcatgttgggcgccgcattgttttatggcgatgtggtgatcaccccggcgatctctgttctcagcgcaacagaaggcttgacggttatctccccaagctttgagcgcttcattctgcccgtatctctcgcagttctgatcgctatttttgcaatccaaccgctcggtacagaaaaagtcggcaaagccttcggccccatcatgttgctgtggtttgtcacccttgcaggattgggaattccgcaaatcatcgggcacccagaaatcttgcagagcttgtctccacattgggccctgcgcttgattgtggctgagcctttccaagcatttgtgctgcttggtgccgttgtcctgacagtaacgggtgcggaagcgctctacgctgatatgggccattttggggcgaggccaatcagagtggcgtggttttgcgtcgtcatgcctgctttaatcttgacgtatttggggcagggcgccttggtgatcaaccagcctgaagcggtgcgcaaccccatgttttatctcgcgccggaaggtctgcggattccgttggttattttggcgaccatcgctacggtgatcgcatcgcaggccgtgatttctggtgcgtattcattgaccaagcaggccgtgaatttgaaactgctgccacgcatggtgatccggcatacctcccgcaaagaggaaggccagatctatatgccactggttaatggattgctgtttgtatccgtgatggttgtggtgctggtattccgatcctctgaaagcctcgccagcgcgtacggacttgcagtgaccggaaccttggtgctggtcagcgtcctgtatctgatctatgttcacaccacatggtggaaaacagcgctgttcattgtgctcatcggtattccagaagtacttctattcgcctcgaacaccacgaaaattcacgacggtggctggcttccactacttattgcggccgtgctcatcgtggtgatgcggacctgggagtggggaagtgaccgcgtcaatcaggaacgcgcagagctggaacttcccatggataagttcttggagaaactcgatcagccacacaatattggtctgcgtaaagttgccgaagtggcagtatttccacatggcaccagcgatactgtcccgttgtcattggttcgctgcgtgaaagacctcaagcttttataccgagagatcgtgatcgttcgaatcgtccaagaacacgttccgcacgtgccaccagaggaacgcgcggaaatggaagtgctccatcacgccccgatcagagtcgtgcgagttgatctgcaccttggttattttgatgagcagaacctgcctgagcatctccatgccattgacccaacatgggataacgccacctacttcctgtctgccctgactcttcggagcaggttgcctggaaagattgctggctggcgtgatcgtttgtatctttcgatggaacgtaatcaggcatctcgaactgagtctttcaaattgcaaccaagcaaaaccatcacggttggaacagagctgcacctttaatcaggcagttgctggccaac

SEQ ID NO: 550 - protein, 628 aa, Corynebacterium glutamicum
MLNRMKSARPKSVAPKSGQALLTLGALGVVFGDIGTSPLYSLHTAFSMQHNKVEVTQENVYGIISMVLWTITLIVTVKYVMLVTRADNQGQGGILALVALLKNRGHWGKFVAVAGMLGAALFYGDVVITPAISVLSATEGLTVISPSFERFILPVSLAVLIAIFAIQPLGTEKVGKAFGPIMLLWFVTLAGLGIPQIIGHPEILQSLSPHWALRLIVAEPFQAFVLLGAVVLTVTGAEALYADMGHFGARPIRVAWFCVVMPALILTYLGQGALVINQPEAVRNPMFYLAPEGLRIPLVILATIATVIASQAVISGAYSLTKQAVNLKLLPRMVIRHTSRKEEGQIYMPLVNGLLFVSVMVVVLVFRSSESLASAYGLAVTGTLVLVSVLYLIYVHTTWWKTALFIVLIGIPEVLLFASNTTKIHDGGWLPLLIAAVLIVVMRTWEWGSDRVNQERAELELPMDKFLEKLDQPHNIGLRKVAEVAVFPHGTSDTVPLSLVRCVKDLKLLYREIVIVRIVQEHVPHVPPEERAEMEVLHHAPIRVVRVDLHLGYFDEQNLPEHLHAIDPTWDNATYFLSALTLRSRLPGKIAGWRDRLYLSMERNQASRTESFKLQPSKTITVGTELHL

SEQ ID NO: 551 - DNA, 1035 bp, Corynebacterium glutamicum
  CDS (101)..(1012): RXN00297
aacaaggcaccggaaaacaagcaacgcaccttgcagaggtggtcttaagcatcttggagcaaaacaacatggcacaataacgatcatgcaacaggtgctcatgggtttcacggtggtgttcatcgtcatcggaataggttggattctcggtagaagagacaccttgggcacacatgcccagaaacctttgagcctgtttgtctattacgtggccaccccagcgttgttgtttgatcgggtcaccaagtcagatacctcgacgattttctctctgaacttcgtggtcattgcactctctgcgttgatcgtaggtttcctgtttttcctactcatgcggttcgtgatcaaaagaactgccgcagtatcggtgatcggcatgctagctgcgtcctacgccaacgccggtaacctgggtatccctttggcagcctatattttggatgatttcaccgtggtgattcccgtgattttgttccaggtggcgttctacgcaccgatcaccatgaccatcatggagatgctgaccaacaagaaatccaccaacttggtgcgcaacctcctggtcacgccactaaccaacaccatggtgctcgcagcgattgccggtattgctgtgtctttgacttcgatgagcgtgcccgtggtgattgctcagccagtggaaatgttggcgaatgcttcagtgccactggctttggtggtgttcggactgtccttgtccaagagcaagatcctggaaaaggggcaggtatccaggcgcgatgtgtttacggcggcactgttcaagaatgttctgcacccaattgttgcgggacttttagccttagcctttggtatggaaggtactgccttgttgtcggcggtgattctcggtgcactgccaacagcgcagaatgtctacacctacgcgttgcgatttagaacagctgaatcgatggcgagagacacaggggtggtcaccacactcatttccttccccgtattggtggcggtctccattatctttggatcttagggttagcattagtggtcatg

SEQ ID NO: 552 - protein, 304 aa, Corynebacterium glutamicum
MGFTVVFIVIGIGWILGRRDTLGTHAQKPLSLFVYYVATPALLFDRVTKSDTSTIFSLNFVVIALSALIVGFLFFLLMRFVIKRTAAVSVIGMLAASYANAGNLGIPLAAYILDDFTVVIPVILFQVAFYAPITMTIMEMLTNKKSTNLVRNLLVTPLTNTMVLAAIAGIAVSLTSMSVPVVIAQPVEMLANASVPLALVVFGLSLSKSKILEKGQVSRRDVFTAALFKNVLHPIVAGLLALAFGMEGTALLSAVILGALPTAQNVYTYALRFRTAESMARDTGVVTTLISFPVLVAVSIIFGS

SEQ ID NO: 553 - DNA, 353 bp, Corynebacterium glutamicum
  CDS (101)..(343): RXN03103
atcttcagagtcacttctttcagtgtcatttttctcggccctaatcccccgctggagttcaatcagcgattgcaaccttttagatatataaggagacaacatgtctgcaaagcgtacttttacccgtatcggtgcgattcttggagcaactgcacttgccggagttaccctcaccgcctgtggtgattcaagcggtggcgacggattcctcgcagccattgaaaatggttctgtcaatgtcggcaccaaatacgatcagcctggtcttggcctccgcaacccagacaactccatgagcggtctcgacgtggatgttgctgaatacgtaattcaactccatcgctgatgacaag

SEQ ID NO: 554 - protein, 81 aa, Corynebacterium glutamicum
MSAKRTFTRIGAILGATALAGVTLTACGDSSGGDGFLAAIENGSVNVGTKYDQPGLGLRNPDNSMSGLDVDVAEYVIQLHR

SEQ ID NO: 555 - DNA, 695 bp, Corynebacterium glutamicum
  CDS (1)..(672): RXN02993
gttgctgaatacgtagtcaactccatcgctgatgacaagggctgggatcaccccaccatcgaatggcgtgaatccccttctgcgcagcgtgaaaccctcattcaaaacggtgaggtagacatgatcgcagcaacctactccatcaacgctggccgttcagagtccgtcaacttcggtggcccatacctgcttacccaccaggctctgcttgttcgccaagatgacgatcgcattgaaaccctcgaggacttggataacggtttgatcctgtgctccgtttccggatccactccagctcagaaggtcaaggatgtcctcccaggcgttcagctccaagaatacgacacctactcttcctgtgttgaggcactgtcccagggcaacgttgacgccctgaccactgacgccaccatcctcttcggctactcccagcagtacgaaggcgacttccgcgttgtggaaatggaaaaggacggcgagccattcaccgacgagtactacggcattggcctgaagaaggatgaccaggaaggcaccgacgctatcaacgccgcacttgagcgcatgtacgctgacggcaccttccagcgactgctcaccgagaacctcggtgaagactccgtggttgttgaagaaggcaccccaggtgacctctccttcctcgacgcaagctagtgtgacggcttttaaaagcc

SEQ ID NO: 556 - protein, 224 aa, Corynebacterium glutamicum
VAEYVVNSIADDKGWDHPTIEWRESPSAQRETLIQNGEVDMIAATYSINAGRSESVNFGGPYLLTHQALLVRQDDDRIETLEDLDNGLILCSVSGSTPAQKVKDVLPGVQLQEYDTYSSCVEALSQGNVDALTTDATILFGYSQQYEGDFRVVEMEKDGEPFTDEYYGIGLKKDDQEGTDAINAALERMYADGTFQRLLTENLGEDSVVVEEGTPGDLSFLDAS

SEQ ID NO: 557 - DNA, 1590 bp, Corynebacterium glutamicum
  CDS (101)..(1567): RXN00349
tgtgtacatcacaatggaattcggggctagagtatctggtgaaccgtgcataaacgacctgtgattggactctttttccttgcaaaatgttttccagcggatgttgagttttgcgacccttcgtggccgcatttcaacagttgacgctgcaaaagccgcacctccgccatcgccactagccccgattgatctcactgaccatagtcaagtggccggtgtgatgaatttggctgcgagaattggcgatattttgctttcttcaggtacgtcaaatagtgacaccaaggtacaagttcgagcagtgacctctgcgtacggtttgtactacacgcacgtggatatcacgttgaatacgatcaccatcttcaccaacatcggtgtggagaggaagatgccggtcaacgtgtttcatgttgtaggcaagttggacaccaacttctccaaactgtctgaggttgaccgtttgatccgttccattcaggctggtgcgaccccgcctgaggttgccgagaaaatcctggacgagttggagcaatcccctgcgtcttatggtttccctgttgcgttgcttggctgggcaatgatgggtggtgctgttgctgtgctgttgggtggtggatggcaggtttccctaattgcttttattaccgcgttcacgatcattgccacgacgtcatttttgggaaagaagggtttgcctactttcttccaaaatgttgttggtggttttattgccacgctgcctgcatcgattgcttattctttggcgttgcaatttggtcttgagatcaaaccgagccagatcatcgcatctggaattgttgtgctgttggcaggtttgacactcgtgcaatctctgcaggacggcatcacgggcgctccggtgacagcaagtgcacgatttttcgaaacactcctgtttaccggcggcattgttgctggcgtgggtttgggcattcagctttctgaaatcttgcatgtcatgttgcctgccatggagtccgctgcagcacctaattattcgtctacattcgcccgcattatcgctggtggcgtcaccgcagcggccttcgcagtgggttgttacgcggagtggtcctcggtgattattgcggggcttactgcgctgatgggttctgcgttttattacctcttcgttgtttatttaggccccgtctctgccgctgcgattgctgcaacagcagttggtttcactggtggtttgcttgcccgtcgattcttgattccaccgttgattgtggcgattgccggcatcacaccaatgcttccaggtctagcaatttaccgcggaatgtacgccaccctgaatgatcaaacactcatgggtttcaccaacattgcggttgctttagccactgcttcatcacttgccgctggcgtggttttgggtgagtggattgcccgcaggctacgtcgtccaccacgcttcaacccataccgtgcatttaccaaggcgaatgagttctccttccaggaggaagctgagcagaatcagcgccggcagagaaaacgtccaaagactaatcagagattcggtaataaaaggtaaaaatcaacctgcttaggcgt

SEQ ID NO: 558 - protein, 489 aa, Corynebacterium glutamicum
MLSFATLRGRISTVDAAKAAPPPSPLAPIDLTDHSQVAGVMNLAARIGDILLSSGTSNSDTKVQVRAVTSAYGLYYTHVDITLNTITIFTNIGVERKMPVNVFHVVGKLDTNFSKLSEVDRLIRSIQAGATPPEVAEKILDELEQSPASYGFPVALLGWAMMGGAVAVLLGGGWQVSLIAFITAFTIIATTSFLGKKGLPTFFQNVVGGFIATLPASIAYSLALQFGLEIKPSQIIASGIVVLLAGLTLVQSLQDGITGAPVTASARFFETLLFTGGIVAGVGLGIQLSEILHVMLPAMESAAAPNYSSTFARIIAGGVTAAAFAVGCYAEWSSVIIAGLTALMGSAFYYLFVVYLGPVSAAAIAATAVGFTGGLLARRFLIPPLIVAIAGITPMLPGLAIYRGMYATLNDQTLMGFTNIAVALATASSLAAGVVLGEWIARRLRRPPRFNPYRAFTKANEFSFQEEAEQNQRRQRKRPKTNQRFGNKR

SEQ ID NO: 559 - DNA, 492 bp, Corynebacterium glutamicum
  CDS (101)..(469): RXN03095
aacgcctcaattagtgccagaccttgccgaccgcagaccaaacttcaccatttcaaaccatccctagccacaacaacggcagttgtgcaatgatctgcgtatgaatgcagataagaaaatgtgcggaatgaacccggatagccaatacgtcgaacttgccgtcgaagttttcggactcctcgcggacgccactcgagttcgcatcatcttggcacttcgaaacagtggtgaactttccgtaaaccacctcgcggacatcgtcgataaatcccccgcagcagtttcccaacacctcgcccggctgcgcatggcccgaatcgtgtccacccgtcaagaaggtcaacgagttttctacaaactcaccaatgaacacgcatcacagctagtctccgacgctatttttcaggcggaacacaccattgcggacggccagactcccccacaccaccaccgagaacgagaacaatcatgaccacccacagtcaccaagaa

SEQ ID NO: 560 - protein, 123 aa, Corynebacterium glutamicum
MNADKKMCGMNPDSQYVELAVEVFGLLADATRVRIILALRNSGELSVNHLADIVDKSPAAVSQHLARLRMARIVSTRQEGQRVFYKLTNEHASQLVSDAIFQAEHTIADGQTPPHHHREREQS

SEQ ID NO: 561 - DNA, 591 bp, Corynebacterium glutamicum
  CDS (101)..(568): RXN03160
gagcatatggtgcgcgcggccgatatgctgatcaattccaaccccgatccgcacgcttaacttctgccaaaaagtcgttttgaccataagctaagcgattgtgaatcgaattgcagaaatcgcacgcagtttcggcgtgctgggcttcagcgctttcggcggccccaccgcgcacctcggatatttccgcacggaattcgtggagcggcggcgctggctggatgatcgccaatattccgagatcgtagcgctcagccaactacttcccggacctggatcgtcgcaggtcggtatgatgctgggctaccaccgcgccggtttttccggcatggcgatcgcctggctcatgtttacctggccctcattggcgctcatggcggcgttcgccctgctttttgatgcgacctccgccagctggacgctcggcctgctcgccgcagcggtcgccgtcgttttcaaacgcagtcaccgggcatggcgcggttcaatggcttccacgccggggcgccggccaccatcgggggtcggcctcggggcatcgcgggtgctcggccctccccaacggggttaacacaccttggggttcaatca

SEQ ID NO: 562 - protein, 156 aa, Corynebacterium glutamicum
VNRIAEIARSFGVLGFSAFGGPTAHLGYFRTEFVERRRWLDDRQYSEIVALSQLLPGPGSSQVGMMLGYHRAGFSGMAIAWLMFTWPSLALMAAFALLFDATSASWTLGLLAAAVAVVFKRSHRAWRGSMASTPGRRPPSGVGLGASRVLGPPQRG

SEQ ID NO: 563 - DNA, 645 bp, Corynebacterium glutamicum
  CDS (101)..(622): RXN02955
atgcactggctcccatcaaagacgaattcttgacctcagaattccagcgtgaactctacgaagcagtgcgcgccgctgatacttcaggaggtgcggcatcatgatgaattttaagtccatcgtgtgcgtcactgcctggcaggtgtttagccgccaggtgctgcacagcccatcaacgtggtctgaagaactatccaagctgttgttcgtgtggctatctttcgcaggtagtgcgttcctctttggagagcgtggacatattgcggttgatttcatcgcgcgcaaactgcctgtttctgcgcagcgggtcctgcaggtcattgttcagttgttgattgttgtttttgcgatcctcggcatgatctggggtggctacttggctgcatcaatcgcgtggaatcagcagctcactgcgctgccacttaccttgggatgggtgtatgttgtcatcccgatcgcgggtgtgttcatcgcgttgttcgcgatcatcgatctcatcgaagtggccacaggcaaggaagagccttacccccttgttgatgaatcagaagaacctcgagatttggacgagctagaggcccaaagcgctatagattctgcaagttcagcggaaggtaggaactaatatgttgtcgccagcagctg

SEQ ID NO: 564 - protein, 174 aa, Corynebacterium glutamicum
MMNFKSIVCVTAWQVFSRQVLHSPSTWSEELSKLLFVWLSFAGSAFLFGERGHIAVDFIARKLPVSAQRVLQVIVQLLIVVFAILGMIWGGYLAASIAWNQQLTALPLTLGWVYVVIPIAGVFIALFAIIDLIEVATGKEEPYPLVDESEEPRDLDELEAQSAIDSASSAEGRN

SEQ ID NO: 565 - DNA, 754 bp, Corynebacterium glutamicum
  CDS (101)..(754): RXN03109
actggcgcttcccgatggtcaatcattggcctttggtgcccaaactggcgagttgttgctccgcgcatcccgcgaactgtatgtgcagggcggcgagtagatggttgtgaaggaggttgacgtcgaaaagcaaaaagctggccgggtgcctggtgctatagctaagcgtcggaccgtgcggattgtgctgtttgtcgcgctgggcgcgatcgtgattgcggcgtcgctgtggtcgattctggtcggccaatacaccatcccgattcgcgatctacctgcgattttagcctccggtccgaccggtgcgcagacgatggcggaacaagtcgtgtggcaaatccgcatgccgcgcatcgtgctgggactgctcgtgggtgccgctttgggcgtggccggcgcgctgttgcaggcggtgttttccaacccgctggcggaaccgtcgatcatcggcgtgacctccggcgcgggcgtgggtgctgctgcggtgatcgtgtttaacctgacatttttgggcacatccaccgtcgcagtcggcgcgtttattaccgcggtgatcaccacgattttggtatatcagctggccagaagccgtggacgtgtgcaagtgatcaacctgatcctgacaggcatagccattaatgcagtatccggcgcgctgacctcagttcttgatctacatcgcgccgacgagctcccgcgaagaaatattttctgcagatgggttcctcacggctcgcatggcgcacgtcaacgt

SEQ ID NO: 566 - protein, 218 aa, Corynebacterium glutamicum
MVVKEVDVEKQKAGRVPGAIAKRRTVRIVLFVALGAIVIAASLWSILVGQYTIPIRDLPAILASGPTGAQTMAEQVVWQIRMPRIVLGLLVGAALGVAGALLQAVFSNPLAEPSIIGVTSGAGVGAAAVIVFNLTFLGTSTVAVGAFITAVITTILVYQLARSRGRVQVINLILTGIAINAVSGALTSVLDLHRADELPRRNIFCRWVPHGSHGARQR

SEQ ID NO: 567 - DNA, 357 bp, Corynebacterium glutamicum
  CDS (101)..(334): RXN02979
ctaggtcaaggaacttcactcggctagtccttagactcaaatgtgttcagacaaacactggcaccgtaaggcacgaaagttaccgaaaggactggttcccatgaccgccccaaacactctcaagcaaacaactcttcgctctgatgagttctcttgcccatcctgtgtctccaagattgaaaacaaattgaatggattggatggcgtcgacaatgcagaggtgaagttctcctccggaagaatccttgttgatcacgaccccagcaaggtctctatcaaggatctagtcgctgcagtcgcagaggttggctacaccgcaaagccatcagcaatctaaaactctcagttagaccatta

SEQ ID NO: 568 - protein, 78 aa, Corynebacterium glutamicum
MTAPNTLKQTTLRSDEFSCPSCVSKIENKLNGLDGVDNAEVKFSSGRILVDHDPSKVSIKDLVAAVAEVGYTAKPSAI

SEQ ID NO: 569 - DNA, 357 bp, Corynebacterium glutamicum
  CDS (101)..(334): RXN02987
gttgtttgatccaggtcaaggaattaacccggaaaggaccgtatctttaaaggtgcaagcacaggaacatgacgataaaagatgaaaggacctggttacgatgaccgcccccgccacgctgaagaacaccaccttgcgctctgatgagttcacctgtccgagctgtgtcgccaagatcgaaaacaagctgaatggtttggacggcgtggagaatgcggaggtgaagttctcctccggacgcatcctgatcacccacgacccacagaaggtctccgtacgtgacctggtcaccgcggtagccgaggtcggttacaccgccaagccgtcggcgatctgacgcactcccgaccccacaag

SEQ ID NO: 570 - protein, 78 aa, Corynebacterium glutamicum
MTAPATLKNTTLRSDEFTCPSCVAKIENKLNGLDGVENAEVKFSSGRILITHDPQKVSVRDLVTAVAEVGYTAKPSAI

SEQ ID NO: 571 - DNA, 1041 bp, Corynebacterium glutamicum
  CDS (101)..(1018): RXN03084
ccacccccacgtctaagttttcccctatttacacacacctgaccgaagctgtaaggtttgcctaatctttttcaatctaaagtcaggatattcacagcccatgtcatctcgcagaaaactctcctccgcactgatcgtgcttctcgcagcagcactacctcttactgcttgttcctccagctcagaagaggaagcatccaccagctctgcgactcgcgaattcacagacgctcacggaacaaccgaagttcccgaaaatcctcagcgcgtcgttgtcctcgagccacttgagctagacaccgcaatcgccctcggaatcaccccagtgggtgcagctgtcgccaacaacgtcactggtattcctgcatatctcggcgtcgatggaatcgagcctgtcggcaccgtttctgagccaaatatcgaagcgatcgctgctctcgagcccgacctgatcctgggcaccgattcccgccacgccgaaatctacgaccgcctcgaatccatcgccccaaccgtgttcatgacaacccatgttgatccgtggaaagacaatgtcgtcttcatcggcgatgcattgggcaagaagcaggaatccgaggatctcatccaaggctttaatgacaagtgcgaagagatcaagtccgagcatgatgtcgaaggtaagaccgtcaacatgattcgtccccgcgacgagcaaaccatgagcctatacggcccgacctcatttgccggcagctctttggagtgcgcaggactcaccattcctgatcaggaatggaaggatgacctccaggccgacatcgctcctgagaacttcatgctcgccaccgccgactacgtctttgtcaccgcaactgatgtcaccgatgaaaatgagctccccgaagtaatccgagaaaaccgcgaacagttcccatcactcacccttgtcgataccagctactgggtatctggcgtcggtccacttggcggcagcaaagtcttggaagacatcgatgccttcctcgacgcacagcaataatgtccacagctctccccgat

SEQ ID NO: 572 - protein, 306 aa, Corynebacterium glutamicum
MSSRRKLSSALIVLLAAALPLTACSSSSEEEASTSSATREFTDAHGTTEVPENPQRVVVLEPLELDTAIALGITPVGAAVANNVTGIPAYLGVDGIEPVGTVSEPNIEAIAALEPDLILGTDSRHAEIYDRLESIAPTVFMTTHVDPWKDNVVFIGDALGKKQESEDLIQGFNDKCEEIKSEHDVEGKTVNMIRPRDEQTMSLYGPTSFAGSSLECAGLTIPDQEWKDDLQADIAPENFMLATADYVFVTATDVTDENELPEVIRENREQFPSLTLVDTSYWVSGVGPLGGSKVLEDIDAFLDAQQ

SEQ ID NO: 573 - DNA, 440 bp, Corynebacterium glutamicum
  CDS (1)..(417): RXN03183
gaagccgaagcaaccgcaggcaaattcgaagtacagcccctcgtaggtaaagacggcgtcggcgtatccacccttggtggctacaacaacggcatcaacgtcaactccgaaaacaaggcaaccgcccgcgacttcatcgaattcatcatcaacgaagagaaccaaacctggttcgcggacaactccttcccaccagttctggcatccatctacgatgatgagtcccttgttgagcagtacccatacctgccagcactgaaggaatccctggaaaacgcagcaccacgcccagtgtctcctttctacccagccatctccaaggcaatccaggacaacgcctacgcagcgcttaacggcaacgtcgacgttgaccaggcaaccaccgatatgaaggcagcgatcgaaaacgcttccagctagttcggtaatttagttcattc

SEQ ID NO: 574 - protein, 139 aa, Corynebacterium glutamicum
EAEATAGKFEVQPLVGKDGVGVSTLGGYNNGINVNSENKATARDFIEFIINEENQTWFADNSFPPVLASIYDDESLVEQYPYLPALKESLENAAPRPVSPFYPAISKAIQDNAYAALNGNVDVDQATTDMKAAIENASS

SEQ ID NO: 575 - DNA, 1077 bp, Corynebacterium glutamicum
  CDS (101)..(1054): RXN01139
accaccgtggcaggctttttcagtggcaagaagattaattctccaccccttcattttcaataagctttcaataaggggagaagtgtgcttagctggggtcatggaaagccacgatcttcagcagcgcagttatgcgcacaatcccgatggccacgaccacagccatgacggactcggacactcacatgctcccagctccctcaaggctctttttgcggtcatcattttcacctcgatcatcttcctagcggaactaatcgccggccttatttccggatctttggcactgctggctgacgccatgcacatgctgtccgactccactggcttgatcattgcggctgtcgccatgctcattggccgtcgggcacgcacttctcgtgcgacctacggatacaagcgtgcggaagtcttggcagcgatggttaacgccaccgttgttacagcactgtctgtgtggatcgtcgttgaggccatcatgcgtctgggcaaggacctggaaatccagaccaacctgatgctcatcgtcgcggtcattggttttgtcaccaacggaatttccgccctggtgttgatgcgccaccaagatggcaatatcaatatgcgtggagcattccttcacgttctcagtgacatgctgggttccgttgccgtcattattgcgggcctggtgattcgctacacgggatggatgccggccgataccattgcttcgattgcgattgctgcgattattattcctcgcgcattcagcctcctgaaggaagctctcaatatcttgttggagcgtgttcctacaggtgcggagcctgcagaggtcgacgcagcccttcgtaaagtcccaggtgtcagcgatgtgcatgatcttcacatttggagcattgacggcaaggaaatcctggccacggtgcatttggtggtggattcgtctacaaatcagctgcatagttgtggcgtgttggatcgggcagaagcggaactatccaaacttgggatcttgcactcaacaattcagctggaaagcgcagatcacagtgatcatgaaagtgtgtgctgatatagagtatgtcccatggg

SEQ ID NO: 576 - protein, 318 aa, Corynebacterium glutamicum
MESHDLQQRSYAHNPDGHDHSHDGLGHSHAPSSLKALFAVIIFTSIIFLAELIAGLISGSLALLADAMHMLSDSTGLIIAAVAMLIGRRARTSRATYGYKRAEVLAAMVNATVVTALSVWIVVEAIMRLGKDLEIQTNLMLIVAVIGFVTNGISALVLMRHQDGNINMRGAFLHVLSDMLGSVAVIIAGLVIRYTGWMPADTIASIAIAAIIIPRAFSLLKEALNILLERVPTGAEPAEVDAALRKVPGVSDVHDLHIWSIDGKEILATVHLVVDSSTNQLHSCGVLDRAEAELSKLGILHSTIQLESADHSDHESVC

SEQ ID NO: 577 - DNA, 2733 bp, Corynebacterium glutamicum
  CDS (101)..(2710): RXN00378
accgtgagccttatactgtgaggacattaaaagtgacacctctttttctatcttttacaacccaagaaggtttatcgtgagcacaccggattcttcctcggtggacaaggccgtaaacactgctatctctgacgccaaaacagcggcgctcaaggcaggtgttggattgaaccgagccaccgcctcagaagaagaggaagatttaagctcaagcattaaggtttctttggcctttgagctcgaggggttaagcaatgcaccatcgttgatggtggtggaaaaagccctagagaagatccccggtgtatccgcggatctgatttacccttcacaaactgcatggattacagcaactgatcgggtacatcccgaaaccctcattgaggtgtttgagcagttcggcatcaaagcacacctttctaattcatcgctgctgcgcaggcatcaacagctcagcgcggaagtaaatagggaagcacgccttgatcgttaccgctcccgaatggatgccaagcgaatctcgcctcgtgtgcgaaggcataaccgacaagaaatggtacatgcggtacgcgctcgtgaaagtggttggattaaacgcaggaatcacaccacctcgcagcatgaagacccaatgtcgggcgatgtgctgttcaccgcccgcgcactgattacacctaagcgtttgtgggtgtcgttgccgtttgcgctcatcgtattggcgttatcgttgaatccttcgtggcagtttgattattggcagtggttgtccgctgtgttggctattcctgtggtggtgtggggtgcctggccgtttcaccgcgctgcagcaggcggtattcgtcgaggaatttccgctcttgatgcgaccagctcaatcgctattgctgctgcatacgcgtggtctatcgccatgctgttgtttgaaaccccaggaggtaaatcctggcggtcatatccgtcctggttcgcttttgaccacggcacgttgacccaaaacgagatttattttgatgtggcctgcggaatcaccgtgttgcttcttgccggacggctgctgacaaggcgtcgaagccaatccagtttgttagcggaacttggtcgcctccaaatcgatccacagcgcattgtcactgtggtgcgtaaacaccgattgaagcgcgtagtccaggaactgaacattccagtgcaggaagtccgtgtcaatgacgatgtgaaagttccacctaataccacgatccctgtggatggcactgtcatcggtggcggttcgcggatcgcagctagcatcatcatgggacaagaccagcgtgatgtaaaagtaaatgacaaagttttcgccggcagcctcaacctcgaatccgaaatcaaggttcgtgttattcgcactggtcaccgcacccgcatcgccgcggtacataggtgggttaaagaagcgacgttgaaggaaaaccgccacaatagggcagcgatccgttcggccggtaaccttgtgcccatcacgttcacccttgctgtggtggacttctgtctgtgggcactgatctctggaaacatcaacgctgcatttaccactaccttggctgtccttgcgtgcgtggctccggtggccttagcgttgtctgctccacttgccacgaggaattccatcgaagctgcagcacgacacggtattttggtccgctctggtgaaattttccgagttctcgatgatgtggatactgccgtatttaatcgtgtgggcacactaaccgatggcgaaatgacagtggaaaccgtcacagcagacaaaggcgaggacccagaactagtgctgcgtgtcgccggggcgttggccatggaatcccaccacgcgatttccaaagcactggtgaaagcatcccgtgaagctcgtgataccggcgccggtggtgaagatgtcccacactggattgaagtaggcaacgtggaaatcaccgaagccggctcattccaagcaaccatcgagctgccactgatcaaaccatctggcgaaaaaatcatgcgcaccacagaagcactcctgtggcgaccacgatccatgacagaagtccgtgagcacttaagcccccgactagtggcagcagcaacctcaggtggcgcaccactgatcgtgcgatggaaaggcaaagaccgcggagttatcactctaagtgaccacgtgagatcagattcctccgatgcgattattgcgattgaagaacaaggcatcgagaccatgatgctttcacgtgatacttacccggtggcacgtcgatacgcagacagcttaggcatcacccacgtcttggccggcatcgcgccgggcaagaaagcccaggtcgtccgtgcagtccacacccgcggatccactgtcgcgatgatcggcgatgaatcagtaatggactgtttgaaagtcgctgacgtgggtgtactgatgggcgtcgatcgtccctcagatctgcgtgatgattccgatgacccggcagctgacgttgtggtcatgcgcgaagaggtcatgagcgtgccgacgctgtttaaactggctcgacgctacgccaagttggtcaatggcaatattgctctggcctggatctataacggtgttgccatggtgcttgcagtgtctggcttgctgcatccaatggctgcgaccgtggctatgctggcgtcttcgctgcttattgaatggcgctcgggcagggcgcgcaagtactaaccagcaattcccaagcccaa

SEQ ID NO: 578 - protein, 870 aa, Corynebacterium glutamicum
VDKAVNTAISDAKTAALKAGVGLNRATASEEEEDLSSSIKVSLAFELEGLSNAPSLMVVEKALEKIPGVSADLIYPSQTAWITATDRVHPETLIEVFEQFGIKAHLSNSSLLRRHQQLSAEVNREARLDRYRSRMDAKRISPRVRRHNRQEMVHAVRARESGWIKRRNHTTSQHEDPMSGDVLFTARALITPKRLWVSLPFALIVLALSLNPSWQFDYWQWLSAVLAIPVVVWGAWPFHRAAAGGIRRGISALDATSSIAIAAAYAWSIAMLLFETPGGKSWRSYPSWFAFDHGTLTQNEIYFDVACGITVLLLAGRLLTRRRSQSSLLAELGRLQIDPQRIVTVVRKHRLKRVVQELNIPVQEVRVNDDVKVPPNTTIPVDGTVIGGGSRIAASIIMGQDQRDVKVNDKVFAGSLNLESEIKVRVIRTGHRTRIAAVHRWVKEATLKENRHNRAAIRSAGNLVPITFTLAVVDFCLWALISGNINAAFTTTLAVLACVAPVALALSAPLATRNSIEAAARHGILVRSGEIFRVLDDVDTAVFNRVGTLTDGEMTVETVTADKGEDPELVLRVAGALAMESHHAISKALVKASREARDTGAGGEDVPHWIEVGNVEITEAGSFQATIELPLIKPSGEKIMRTTEALLWRPRSMTEVREHLSPRLVAAATSGGAPLIVRWKGKDRGVITLSDHVRSDSSDAIIAIEEQGIETMMLSRDTYPVARRYADSLGITHVLAGIAPGKKAQVVRAVHTRGSTVAMIGDESVMDCLKVADVGVLMGVDRPSDLRDDSDDPAADVVVMREEVMSVPTLFKLARRYAKLVNGNIALAWIYNGVAMVLAVSGLLHPMAATVAMLASSLLIEWRSGRARKY

SEQ ID NO: 579 - DNA, 1925 bp, Corynebacterium glutamicum
  CDS (1)..(1902): RXN01338
aaaacttataccccaaatccctggatgttattcatccgctcatttgatggcatcatcactgtcgcagcccttgttgccatcgcaatacatctcattttatggctggctctagatctagatggccttgctaaaaactggcctttaatagccatcgttatcgtaggtggcattccgttgatgtgggatgtgctgaaatcagccattaaaactcgcggtggcgcggatactttagcagcagtctccatcattacttctgtgttgttaggggagtggttggttgccgcgatcatcgtgctcatgctctctggtggtgaagcgctagaagaggcagcatcacggcgagccagtggcaccttggacgcacttgcccggcgcgcaccaagtacagctcaccgcctgttgggtgcaaccattcttgatggaaccgaagagatcgccgtggaagagatcacggttggtgatttagtggcggtgctcccgcatgaactttgtcccgtggatggtgaaatcgtggcaggccacggcaccatggatgagtcttatctcacgggtgagccctatgtggtgagtaaatctaaaggttcgcaagcaatgtcgggtgcagtcaatggtgatactccgctgacgattgttgccacaaagcttgcccatgattccagatacgcccaaattgttggtgtactccatgaagcagaaaacaaccgcccagaaatgcgcaggatggctgaccgtcttggcgcgtggtatacggtgattgcacttgccctcggtggtcttggctggattgtctccggcgacccagtgaggttcttggctgttgtcgttgtcgccaccccatgtccattgctcattgcagtgccagtggcgatcatcggtgcgatttctcttgcggctcgtcggggcatcatcgtgaagaaccctggaatgctggaaaacgcttcaggagtaaagacagtgatgttcgataagactggaacgctcacctatggcaggccagtgattactgatatccacactgctcccggagttgaggaagatacagtcctagctttggctgcttcagtagagcgctactccagacacccgttggctgacgcgattcgtgagggcgcaaaagccagggaacttcatctgcctgatgtagtggaagtatcggaacgtccaggacagggactaaccggcacggtgggcgagcacctggttcgaataaccaataggcgcagcacactagaaattgatccagacagcaagaactacattccggtgacaagttccggcatggaatctgtggtgcttgttgatgataaatatgcagcactcattcgcctccgggatgaacctcgtgcatctgccagtgagttcatcgcgcacttgcccaagaagcacaaagtggacaagctcatgattatctctggtgatcgcgcatctgaggttcgttaccttgcggacaaggttggcattgatgaggtacacgcagaggcctcaccggaagacaagctgaacattgttaatcggcataatgagcacggcgccaccatgttcttaggtgatggaatcaacgatgcgccagccatggccgttgccaccgttggtgtcgcgatgggagcagactccgatgtcacgtccgaagcagcagatgctgtgattttggattcttccctggaacgtctcgacgatctgctccacatcagtgcacggatgcgtcgaatagcgttgcaatctgcgggcggtggcatggcgttgagtgtcataggaatgatcctcgcggtatttggattcttgacgccactgatgggtgcgatcttccaagaggtcattgacgtgctggctatcctcaattccgctcgggtcgcactgccacgcggagcgattagtgattttgatacgcaagaaaaagtttcttagcagggtaacctaaatgtcgt

SEQ ID NO: 580 - protein, 634 aa, Corynebacterium glutamicum
KTYTPNPWMLFIRSFDGIITVAALVAIAIHLILWLALDLDGLAKNWPLIAIVIVGGIPLMWDVLKSAIKTRGGADTLAAVSIITSVLLGEWLVAAIIVLMLSGGEALEEAASRRASGTLDALARRAPSTAHRLLGATILDGTEEIAVEEITVGDLVAVLPHELCPVDGEIVAGHGTMDESYLTGEPYVVSKSKGSQAMSGAVNGDTPLTIVATKLAHDSRYAQIVGVLHEAENNRPEMRRMADRLGAWYTVIALALGGLGWIVSGDPVRFLAVVVVATPCPLLIAVPVAIIGAISLAARRGIIVKNPGMLENASGVKTVMFDKTGTLTYGRPVITDIHTAPGVEEDTVLALAASVERYSRHPLADAIREGAKARELHLPDVVEVSERPGQGLTGTVGEHLVRITNRRSTLEIDPDSKNYIPVTSSGMESVVLVDDKYAALIRLRDEPRASASEFIAHLPKKHKVDKLMIISGDRASEVRYLADKVGIDEVHAEASPEDKLNIVNRHNEHGATMFLGDGINDAPAMAVATVGVAMGADSDVTSEAADAVILDSSLERLDDLLHISARMRRIALQSAGGGMALSVIGMILAVFGFLTPLMGAIFQEVIDVLAILNSARVALPRGAISDFDTQEKVS

SEQ ID NO: 581 - DNA, 1917 bp, Corynebacterium glutamicum
  CDS (101)..(1894): RXN00980
agagagaaagggagaaatcatgaaaacgtggaagacctggggggtcgtcggagcttcaggcctcttgattattttgtcgtggttgagttcatcgagcccgatgctggcagatgcattcatgatcgcggctgcaattgttgcaggttggccgatcgcgcagtctgcatatcaagcacttcgcattcgaatggtgtcgattgacttactggtcgttgtggctgccgttggtgccatgttcatcaacaactattgggagtctgcggcggtgacgttcctctttgcccttggcaaggcactggaacgcgcgacaatgaaccgcacacgaaaagcactatcggatctggtggatgcagctccagaaactgcaacaaggctcaacgcggatgactcaacagaggtagttgagctgtgggagcttgagcccggtgacatcgtcttggtacgcaatggcgaacaaattcccgtcgatggaaacgtgattgcgggtgtcggtggaattgatgaatccaacatcacgggtgaatcaatgccggctgaaaagggtcaaggctctgatgtgtatgcaggaacctggctgcgatctggtgttttgagagtcgaggcaacaggaattggttcagactcaactttggcaaaaatcattcaccgcgttgaagacgcccaggatgacaaagcccgcacacaaacattcttagagaaattctctaagtggtacaccccgggcgtcatgatcgccgccgcagtggtgggacttatcacctgggacgtagaactagcactgacgctcttagtgatcggctgccccggcgcgttggttatctccatcccggtgtccatcgtcgcaggcatcggccgtgctgcacgcgatggcgtgctgatcaagggtggagaatacctagaaaccgccgcgaaagtcgacgtcgttgtcgtggacaaaactggaacgctgaccaccggccgcccagaactcacagacgtagaagtcatcgagcccgcctacagccagggcgaggtgctggagctcgccgcgcgcgccgagacggcttcagaacatccgcttgccgacgccatcatccgtggtgcccaggatcgggggctgtccacaacattggtggaagcagctgaaaacatcaccggccgaggcattatcgcaaatgttgatggacaggcagttgctgttggatctgctgagttacttgatcatgaaccagactcgaccaggatcctggagctaaatgccgaaggaaagaccgcgatgtttgtcggagtgaacggacacgccattggaatcgtggccgtcgccgacgccgttcgttcagattctgcctcagcaatcgaatcgctgcataaggcgggcattcaagttgtcatggcgactggcgacgctcaccgcgttgcacaaaacgtggcctccaagctgggagtggatgaagtctactcagagctactccctgaacagaaattagaactggtgcgtgatctgcaagctgccggcaaaacggtcgcgatggtgggtgacggagtcaacgacaccccagcattggcagctgctgatatcggagtagcgatgggcgtggcaggttcccctgcagccattgaaaccgctgatatcgcactcatggcggatcgtctcccacggctggcacatgcagtgaccttggcaaaacgcaccgtaagaaccatgcgcatcaatattctgattgcgttggctaccgtgatggtgttactagctggcgtcctatttggcggagttaccatgtcggttggcatgctcgttcacgaagcaagcgtgctgcttgttatcagcatcgccatgctgttgctgcgtccaacacttaaagaagatgctgcgcaagcaagtgatattaaacgctcggaaatacaacagatcgcataaccaatggctgggtactgatg

SEQ ID NO: 582 - protein, 598 aa, Corynebacterium glutamicum
MLADAFMIAAAIVAGWPIAQSAYQALRIRMVSIDLLVVVAAVGAMFINNYWESAAVTFLFALGKALERATMNRTRKALSDLVDAAPETATRLNADDSTEVVELWELEPGDIVLVRNGEQIPVDGNVIAGVGGIDESNITGESMPAEKGQGSDVYAGTWLRSGVLRVEATGIGSDSTLAKIIHRVEDAQDDKARTQTFLEKFSKWYTPGVMIAAAVVGLITWDVELALTLLVIGCPGALVISIPVSIVAGIGRAARDGVLIKGGEYLETAAKVDVVVVDKTGTLTTGRPELTDVEVIEPAYSQGEVLELAARAETASEHPLADAIIRGAQDRGLSTTLVEAAENITGRGIIANVDGQAVAVGSAELLDHEPDSTRILELNAEGKTAMFVGVNGHAIGIVAVADAVRSDSASAIESLHKAGIQVVMATGDAHRVAQNVASKLGVDEVYSELLPEQKLELVRDLQAAGKTVAMVGDGVNDTPALAAADIGVAMGVAGSPAAIETADIALMADRLPRLAHAVTLAKRTVRTMRINILIALATVMVLLAGVLFGGVTMSVGMLVHEASVLLVISIAMLLLRPTLKEDAAQASDIKRSEIQQIA

SEQ ID NO: 583 - DNA, 1296 bp, Corynebacterium glutamicum
  CDS (101)..(1273): RXN00099
ctctggtgaagaggatgttgactcgggagattcttccactgattcactgattaagtggtaccgcgcaaataggtagtcgcttgcttatagggtcaggggcgtgaagaatcctcgcctcatagcactggccgctatcatcctgacctcgttcaatctgcgaacagctattactgctttagctccgctggtttctgagattcgggatgatttaggggttagtgcttctcttattggtgtgttgggcatgatcccgactgctatgttcgcggatgctgcgtttgcgcttccgtcgttgaagaggaagttcactacttcccaactgttgatgtttgccatgctgttgactgctgccggtcagattattcgtgtcgctggacctgcttcgctgttgatggtcggtactgtgttcgcgatgtttgcgatcggagttaccaatgtgttgcttccgattgctgttagggagtattttccgcgtcacgtcggtggaatgtcgacaacttatctggtgtcgttccagattgttcaggcacttgctccgacgcttgccgtgccgatttctcagtgggctacacatgtggggttgaccggttggagggtgtcgctcggttcgtgggcgctgctggggttggttgcggcgatttcgtggattccgctgttgagtttgcagggtgccagggttgttgcggcgccgtcgaaggtttctcttcctgtgtggaagtcttcggttggtgtggggctcgggttgatgtttgggtttacttcgtttgcgacgtatatcctcatgggttttatgccgcagatggtaggtgatcctcagctcggtgcggtgttgttaggctggtggtcaattttgggattgccgctgaacattctgggaccgtggttggtgacgcgtttcactaactgcttcccgatggttgttatcgccagtgtcatgtttctcatcggtaatggtgggttttgtttggctccggatgttgcgccgtggttgtgggcgacgttgtctggtcttggtccccttgcgttcccgatggcgttgacgctcattaatattcgtgctgaaactagtgctggtgcttctgcgttgagttccttcgggcagggtttgggttatacgattgcgtgtttcggtcccttgttgactggtttcattgtcgatgcgacaggcagcttccgaacaatctttgtgctttttgcggttgcaacactcttcgttattagaggcggttactttgcgacaaggcaggtttacgtcgaaaagcttttaaatcgctaggatggcgctatgccgcaaag

SEQ ID NO: 584 - protein, 391 aa, Corynebacterium glutamicum
VKNPRLIALAAIILTSFNLRTAITALAPLVSEIRDDLGVSASLIGVLGMIPTAMFADAAFALPSLKRKFTTSQLLMFAMLLTAAGQIIRVAGPASLLMVGTVFAMFAIGVTNVLLPIAVREYFPRHVGGMSTTYLVSFQIVQALAPTLAVPISQWATHVGLTGWRVSLGSWALLGLVAAISWIPLLSLQGARVVAAPSKVSLPVWKSSVGVGLGLMFGFTSFATYILMGFMPQMVGDPQLGAVLLGWWSILGLPLNILGPWLVTRFTNCFPMVVIASVMFLIGNGGFCLAPDVAPWLWATLSGLGPLAFPMALTLINIRAETSAGASALSSFGQGLGYTIACFGPLLTGFIVDATGSFRTIFVLFAVATLFVIRGGYFATRQVYVEKLLNR

SEQ ID NO: 585 - DNA, 387 bp, Corynebacterium glutamicum
  CDS (101)..(364): RXN02662
ccaaggtgtcaccctcaccgttgccatcgccttcatcatcgtcaatatcgccgtggacctgctctacgtcctggtcaatccacgtattaggagcatctagatgcgccgtaaactaaccaccacattagaaaacaagcccggtgcacgacttggtggcttccgcgcacttgcaccaacttcaaaaatcgcgctggttttccttctcctgatcttcctcctcgcgatctttgccccactgattgctaaatacgatccactggcctccggaactccagtccagcctccaagcggtgagcactggtttggtaccgacgccatcggccgcgatattttctcccgcgtagccacggcgccagagcctccctgatcattggtcttttcgctacg

SEQ ID NO: 586 - protein, 88 aa, Corynebacterium glutamicum
MRRKLTTTLENKPGARLGGFRALAPTSKIALVFLLLIFLLAIFAPLIAKYDPLASGTPVQPPSGEHWFGTDAIGRDIFSRVATAPEPP

SEQ ID NO: 587 - DNA, 972 bp, Corynebacterium glutamicum
  CDS (101)..(949): RXN02442
gccgtgatgttgttgagcgcgatgtgattgccgtatgtgcatgtgagattccggacgctgagttctgccattccttaatgataacggttatcattttcaaatgaagttttttactgacgccctcatagtgccttttgacgtttcattcatctcccgcgccctggtcgccggatgcctggccgcaattttatgctcactcattggaacgtgggttattttgcgcaggctaacctttttcggcgacgctatgtcgcacggcttgctccccggagtagccacggcatcactattgggcggaaatctcatgttcggcgcagcaatcagcgcattaatcatgtcagccggagtggtgtggaccagcagaaaatccagcctctcccaagacgtcagcattggcctgcaatttattaccatgctttccctcggcgtggttattgtgtcccactccgattcccacgccgtagacctcaccagtttcctttttggagacattcttggcgtgcgaccctcggatatattcatcatcgccattgcaacagtgttgggtggattgactatttttctcttccaccgacagttcactgcactcgctttcgacgagcgtaaagctcacaccttaggactcaatccccgctttgcacacctactcatgctggcactgatcgcattagctacggtggtgtcgtttcaggtggtgggaacgcttttagtgtttggacttctcattggtccgcccgccacggctgcacttttagtgcaagacaaagcaagtatttcactgatcatgatcgtcgcgtcgcttcttggatgcgcggaaatttacctcgggcttttaatcagctggcacgcaagcactgccgcgggagccactatcactttgttaagtgctgcgatattttttgccaccttattgacaaagagtgccattagtaggttaaacttcaccgcgtgatactgaaagacattttcaat

SEQ ID NO: 588 - protein, 283 aa, Corynebacterium glutamicum
MKFFTDALIVPFDVSFISRALVAGCLAAILCSLIGTWVILRRLTFFGDAMSHGLLPGVATASLLGGNLMFGAAISALIMSAGVVWTSRKSSLSQDVSIGLQFITMLSLGVVIVSHSDSHAVDLTSFLFGDILGVRPSDIFIIAIATVLGGLTIFLFHRQFTALAFDERKAHTLGLNPRFAHLLMLALIALATVVSFQVVGTLLVFGLLIGPPATAALLVQDKASISLIMIVASLLGCAEIYLGLLISWHASTAAGATITLLSAAIFFATLLTKSAISRLNFTA

SEQ ID NO: 589 - DNA, 1077 bp, Corynebacterium glutamicum
  CDS (101)..(1054): RXN02443
caagcactgccgcgggagccactatcactttgttaagtgctgcgatattttttgccaccttattgacaaagagtgccattagtaggttaaacttcaccgcgtgatactgaaagacattttcaataatggggagctctttggggcttcctccgcgaaaaatttccgaaaactactagctgttccagccgttgccgcctcactagcttttggtatcaccgcctgttccgctgtagatgacacccctgacattgtggtcaccaccaacatcctgggtgatgttgtaagccatatcgtgggagattccgcagatgtccaagtactcatgaaacccaacgcagatccacattccttcggagtctcagcacaagacgccgctgccatggaacatgccgatctcatcgtggccaatggactaggacttgaagagggccttcaatccaatgtggacaatgccaaaagccaaggggttcccgtcttggaagtcggcgaacacatcgatgtcattgactactcccccggcgttccagatcctcacttttggacagacccggcgcgcatgatcgccgccacggaagttatagaagctgaactgatcaaagaactcgatccttccctgactgaatcgatcacacaatcagcccagcactaccgtgaggaacttgttgcccttgatgaggaagtcaccgaattgctcagcggcgtggccccagaaaaccgcaagctggtaaccaatcacaatgtttttggatacctggccagccggtttaactacaccgtcattgacaccatcatcccaggtggaagcacattggcggcgccttcagcatctgacctcaatgacatctccaccgccatcgaagacaacaatgttcccgcaatcttcaccgatacctcaagcccacaacggttagctgaagtgttggccagcaacgctggcattgatgttcaagtggtgtccattttcacggaatcactcaccgatgcagatggtgaagcacccacctacatcagcatgcaaaaaatcaatgccgagcgcattgcaagcactttgtcctaaacagtcctaaacagtcttaa

SEQ ID NO: 590 - protein, 318 aa, Corynebacterium glutamicum
VILKDIFNNGELFGASSAKNFRKLLAVPAVAASLAFGITACSAVDDTPDIVVTTNILGDVVSHIVGDSADVQVLMKPNADPHSFGVSAQDAAAMEHADLIVANGLGLEEGLQSNVDNAKSQGVPVLEVGEHIDVIDYSPGVPDPHFWTDPARMIAATEVIEAELIKELDPSLTESITQSAQHYREELVALDEEVTELLSGVAPENRKLVTNHNVFGYLASRFNYTVIDTIIPGGSTLAAPSASDLNDISTAIEDNNVPAIFTDTSSPQRLAEVLASNAGIDVQVVSIFTESLTDADGEAPTYISMQKINAERIASTLS

SEQ ID NO: 591 - DNA, 1323 bp, Corynebacterium glutamicum
  CDS (101)..(1300): RXN00842
ccttgtcgcggaggtaagcgagggtatttctggatgtggaacaacgcggattatggaaaatcgtgactttcataacgttgagcctactaaggtttgttccatgattattcaaatcctaagagtggcatttgccttcgtcggcatcattgttggcgccggtttcgcatcagggcaagaggtcatgcaatattttgtggccttcggcatagacggaatttggggagtcattgtttctgcagtgatcatgtcggtgatggcgttgatcattttgcagctcggaagctatttcaatgcaggtgaacacggtgaagtgttccgccgagtaagtcaccccgttttctccaaaattttggacatcggcgttgtggtgacgttgttctccaccggtttcgtcatgtttgcaggcgcgggatcaaatctgaatcagcagtgggggcttccgctctggatcggttctgtgatcatggttcttctggtgctggctgcgggcatgttggacgtggataaagtaaccacagtcattggtgcaattactccgttcatcatcattttcatcactgccgcctcgatctacacgctggtaggtaatttcagctcagtggagcagcttgattctgctgctttagaagtcggcacgacgttgcctcactgggctgttgcagcggtgaactatgtgggattcaacctgatggttgcggtgtccatggctgtggtcattggtggatcaatgtttaacccgcgggtcgcaggtcggggcggtttgctgggcggattgatcctgggattcttgatcatcatcagtgcgctaacactgttcgccaccgtggaagaagttggccaagatgatatgcctatgctgacgatcatcaacaatttgaacccgctggctggccaagtaatggcagtggttatctacggaatgatcttcaacacggcactgggtatgttctacgcattgggccgtcgtctcactgcgaaaaacccacagcgattccgtccggtttatgtggtcacagtgctgattggttttgtgttgagctttgtgggattcaagaacttggtgggctatgtgtacccagtcttgggatacattggcctgctgctgattgcagtgatgatggtggcgtgggtgaggggacgcgtacgcatctacaaggaatccgaacgccgcatgcggatcgcagacttgttgcagatcggccatgacggagcgttgagtggagcagagctggcggtgctcaaccaggaaatccaagattcaaacttggatgaggaacaaattaaagcagcggttaggaagtagttactctgcagggacgagct

SEQ ID NO: 592 - protein, 400 aa, Corynebacterium glutamicum
MIIQILRVAFAFVGIIVGAGFASGQEVMQYFVAFGIDGIWGVIVSAVIMSVMALIILQLGSYFNAGEHGEVFRRVSHPVFSKILDIGVVVTLFSTGFVMFAGAGSNLNQQWGLPLWIGSVIMVLLVLAAGMLDVDKVTTVIGAITPFIIIFITAASIYTLVGNFSSVEQLDSAALEVGTTLPHWAVAAVNYVGFNLMVAVSMAVVIGGSMFNPRVAGRGGLLGGLILGFLIIISALTLFATVEEVGQDDMPMLTIINNLNPLAGQVMAVVIYGMIFNTALGMFYALGRRLTAKNPQRFRPVYVVTVLIGFVLSFVGFKNLVGYVYPVLGYIGLLLIAVMMVAWVRGRVRIYKESERRMRIADLLQIGHDGALSGAELAVLNQEIQDSNLDEEQIKAAVRK

SEQ ID NO: 593 - DNA, 1323 bp, Corynebacterium glutamicum; identical to SEQ ID NO: 591
  CDS (101)..(1300): FRXA00842

SEQ ID NO: 594 - protein, 400 aa, Corynebacterium glutamicum; identical to SEQ ID NO: 592

SEQ ID NO: 595 - DNA, 1173 bp, Corynebacterium glutamicum
  CDS (101)..(1150): RXN00832
gagattgtgctaggttctgatgaggcttcgggacgacccgaagaaatctatgacagcctgggaacggcccagagttcttaagaaagtttgactagagaacatgccgttttcttggctaaaaccaattgattatgcccgcatctttgtcggctgggcatcgatttttatcatccccctcatcacactgccatcaattattgagttggcgctgatcgtggcagtcatcctattctgcgcatttggcgtggtgaagatggcggagcgtttggctcatattttgggtgatccttttggatcgttgatccttaccttgtcgatcgtgatcattgaagtgattttgatctgtgcggtgatgctggggcctgctgattcaaccactgctggtcgggattccgtgatggcagtgtccatgatcatcatgggtttggtcgtgggattgtgcctactcattggtggtttaaggcatggaagcatgccacacaatggggtgggaactccgacctacttggtgctgatcgcaactttttccgtaatcgcctttgcggttccagctttcaggggagaatactccactgggcaggcacttgttatttcaacactgacagcagtggtgtacgggttcttcctgtttcgccaaatgggtgcccaagctggtgaatttcaagaggtcgaggtcgcagaaaaggcagacgacgcagcaaaatgggaggtcccatttagaggcttaatcttgattatcactgtgctccccatcgtgttgctgtcccatgacatggccacggtgatggatgaagtcctggcaagccttggtgcacccgtagcaatggctggattaattattgccaccattgtcttcttgccagagaccatcacctccttgaaagctgcgtggacaggagagattcagcgagtaagcaacctcgcgcatggagcccaagtatcaacggtggggctgacaatcccagctgttctagtgatcggcgtgatcacaggtcaagatgtagttttgggggagaccccgatcaacttgttgctgctgggaaccaccattgcggtgacagccattgcgtttagctccaagaaagtcagtgctgtgcatggctcggtgctgctcatgcttttcggtgtttacatgatgagcatgttcgcctgatttaggtagcctggtgggaa

SEQ ID NO: 596 - protein, 350 aa, Corynebacterium glutamicum
MPFSWLKPIDYARIFVGWASIFIIPLITLPSIIELALIVAVILFCAFGVVKMAERLAHILGDPFGSLILTLSIVIIEVILICAVMLGPADSTTAGRDSVMAVSMIIMGLVVGLCLLIGGLRHGSMPHNGVGTPTYLVLIATFSVIAFAVPAFRGEYSTGQALVISTLTAVVYGFFLFRQMGAQAGEFQEVEVAEKADDAAKWEVPFRGLILIITVLPIVLLSHDMATVMDEVLASLGAPVAMAGLIIATIVFLPETITSLKAAWTGEIQRVSNLAHGAQVSTVGLTIPAVLVIGVITGQDVVLGETPINLLLLGTTIAVTAIAFSSKKVSAVHGSVLLMLFGVYMMSMFA

SEQ ID NO: 597 - DNA, 1119 bp, Corynebacterium glutamicum
  CDS (101)..(1096): RXN00466
tttaaaagcgcactaagagctcgtcaattctttaaaacaagctgagaatgtgaataataggataggttaacctgattcgattagaaaacggagatttgtcgtgcaatcccgcctgtccaaaatcctgcgcagtagcgtcgtaggcgttgctgtcctagccctgttagctgggtgttctaacaatgcagatgacaccgacgctgattcaacatccacgggaaactccgcttttcctgtttcgattgaacacgagttcggaaccaccacaatcgatgatgtacccgaaagagttgtcacccttggcgttaccgacgccgatattgtcctcgcattggggaccgtcccagtaggcaacaccggatacaaattcttcgaaaacggattgggaccgtggactgatgagttagtggaaggcaaagaattaacactgcttgactctgattccacaccagatcttgaacaagtagcagccctggagccagacctgattattggagtctctgcggggtttgacgacgttgtatacgagcaactatctgatatcgcaccggtggtcgcccgtccagcgggaacagctgcatacgcagtagctcgcgaggaagctaccaaccttgttgcccgtgcgatggggcaatcagaaaaaggacaagagctcaatgaggaaacagatgctctgatccaagctgcgcgtgatgaaaatccttcttttgacggtaaaacaggaaccgtcatcttgccataccagggtaaatacggtgcctacctgccaggcgatgcacggggacaattcctcgattcacttggcatttcgctgccggaagcagttctttcgcgagacaccggcgacagcttctttgtcgatgtccccgctgaaagcgtcaaagacgtagacggtgatgttctcctcgtgctttccaacgacgaaaatctggatatcacagcagagaatccactgtttgaaacactcaacgttgtgcaaaaagacgcagtaattgtggcaacaaccgaagaacgcggggcgattacctacaactcagtgctgtctgttccttttgcgttggaacatctcgcaccacgtattgctgaggctttgaagtaaaactcaactactcgagcaca

SEQ ID NO: 598 - protein, 332 aa, Corynebacterium glutamicum
VQSRLSKILRSSVVGVAVLALLAGCSNNADDTDADSTSTGNSAFPVSIEHEFGTTTIDDVPERVVTLGVTDADIVLALGTVPVGNTGYKFFENGLGPWTDELVEGKELTLLDSDSTPDLEQVAALEPDLIIGVSAGFDDVVYEQLSDIAPVVARPAGTAAYAVAREEATNLVARAMGQSEKGQELNEETDALIQAARDENPSFDGKTGTVILPYQGKYGAYLPGDARGQFLDSLGISLPEAVLSRDTGDSFFVDVPAESVKDVDGDVLLVLSNDENLDITAENPLFETLNVVQKDAVIVATTEERGAITYNSVLSVPFALEHLAPRIAEALK

SEQ ID NO: 599 - DNA, 1395 bp, Corynebacterium glutamicum
  CDS (101)..(1372): RXN01936
gcgcggtgacaccacagccgttgtcagcggcgcttggtctgtggaggatcgccgaggttactaacaaataggcccaacaaagaggtctaagctctacctggtgagtttccgagatattttcgctgacaccagaccgctgaaagaaccggccttcaaacgcctctggcttggcaatgttgccaccgtcattggtgcccaattaactgttgttgccgttccggtgcagatttaccaaatgactgggtcctccggctatgtgggcttgaccgggctttttggccttattcctttggttatttttggcctttatggtggatccattgcggatgcttttgataaacgcatcgtgctgatctgcaccacgatcggcatgtgtgtcaccactgccggtttttgggtgctgaccattttaggcaatgagaatatttggctcctgttaataaacttttctttacagcaggcatttttcgcggtgaatcaacccacccgaacggcgatccttcgaagtattttgccgattgatcaattagcgtcggcaacatcactgaatatgctgctcatgcagaccggcgcaatcgttggcccgctgatcgcaggtgcgttgattccgctgatcggtttcgggtggctgtatttccttgatgttgtctccatcatccccacactgtgggctgtatggtcactgccttcgatcaagccatccggcaaggtgatgaaggctggtttcgccagtgtggtggatggcctgaagtatttggctggccaacccgtgttgttgatggtgatggtgctggatcttatcgccatgattttcggcatgccacgtgcgctttaccccgagatcgcagaagtgaacttcggtgggggtgacgccggtgcaacgatgctggcgttcatgtactcatccatggctgttggcgcagttcttggcggcgtgctgtctggttgggtggcccggattagccgccagggtgttgcagtttattggtgcatcatcgcctggggcgcagccgttgctttgggtggtgtggcaattgttgtcagccccggcgcggtgactgcgtgggcgtggatgttcatcatcatgatggtcattggtggcatggctgacatgttcagctcggcagttcgaaacgctattttgcagcagtctgctgcggaacatgtgcagggccgaatccaaggtgtgtggatcatcgtcgtggtgggtggacctcgtttagctgacgtccttcacggttgggccgctgagcccctcggcgcaggttggacggtattatggggcggagtagcggtggttgtactcactgcaatttgtatggtggcggtgcctaaattctggaaatacgagaaaccaaaaattaccggcatctaaatacttatccatgcccattt

SEQ ID NO: 600 - protein, 424 aa, Corynebacterium glutamicum
VSFRDIFADTRPLKEPAFKRLWLGNVATVIGAQLTVVAVPVQIYQMTGSSGYVGLTGLFGLIPLVIFGLYGGSIADAFDKRIVLICTTIGMCVTTAGFWVLTILGNENIWLLLINFSLQQAFFAVNQPTRTAILRSILPIDQLASATSLNMLLMQTGAIVGPLIAGALIPLIGFGWLYFLDVVSIIPTLWAVWSLPSIKPSGKVMKAGFASVVDGLKYLAGQPVLLMVMVLDLIAMIFGMPRALYPEIAEVNFGGGDAGATMLAFMYSSMAVGAVLGGVLSGWVARISRQGVAVYWCIIAWGAAVALGGVAIVVSPGAVTAWAWMFIIMMVIGGMADMFSSAVRNAILQQSAAEHVQGRIQGVWIIVVVGGPRLADVLHGWAAEPLGAGWTVLWGGVAVVVLTAICMVAVPKFWKYEKPKITGI

SEQ ID NO: 601 - DNA, 1461 bp, Corynebacterium glutamicum
  CDS (101)..(1438): RXN01995
ccgacgcaaaggcatgcgcctgcgtgtctcgagtagtctcctccccttcctcgtccccaacctcgaccattacggtcgccctctcctaaaggagcctggcatggatatccgccaaacaattaacgacacagcaatgtcgagatatcagtggttcattgtatttatcgcagtgctgctcaacgcactggacggctttgatgtcctcgccatgtcttttactgcgaatgcagtgaccgaagaatttggactgagtggcagccagcttggtgtgctgctgagttccgcgctgttcggcatgaccgctggatctttgctgttcggtccgatcggtgaccgtttcggccgtaagaatgccctgatgatcgcgctgctgttcaacgtggtgggattggtattgtccgccaccgcgcagtccgcaggccagttgggcgtgtggcgtttgatcactggtatcggcatcggcggaatcctcgcctgcatcacagtggtgatcagtgagttctccaacaacaaaaaccgcggcatggccatgtccatctacgctgctggttacggcatcggcgcgtccttgggcggtttcggcgcagcgcagctcatcccaacatttggatggcgctccgtgttcgcagccggtgcgatcgcaactggtatcgccaccatcgctactttcttcttcctgccagaatccgttgattggctgagcactcgccgccctgcgggcgctcgcgacaagatcaattacattgcgcgccgcctgggcaaagtcggtacctttgagcttccaggcgaacaaagcttgtcgacgaaaaaagccggtctccaatcgtatgcagtgctcgttaacaaagagaaccgtggaaccagcatcaagctgtgggttgcgttcggcatcgtgatgttcggcttctacttcgccaacacttggaccccgaagctgctcgtggaaaccggaatgtcagaacagcagggcatcatcggtggtttgatgttgtccatgggtggagcattcggctccctgctctacggtttcctcaccaccaagttcagctcccgaaacacactgatgaccttcatggtgctgtccggcctgacgctgatcctgttcatttcctccacctctgttccatccatcgcgtttgccagcggcgttgtcgtgggcatgctgatcaatggttgtgtggctggtctgtacaccctgtccccacagctgtactccgctgaagtacgcaccactggtgtgggcgctgcgattggtatgggtcgtgtcggtgcgatttccgcgccactgctggtgggtggcctgctggattctggctggtccccaacgcagctgtatgttggtgtggcagtgattgttattgccggtgcaaccgcattgattgggatgcgcactcaggcggtagccgtcgaaaagcagcctgaagccctagcgaccaaatagggccgcgattcctagcatgc

SEQ ID NO: 602 - protein, 446 aa, Corynebacterium glutamicum
MDIRQTINDTAMSRYQWFIVFIAVLLNALDGFDVLAMSFTANAVTEEFGLSGSQLGVLLSSALFGMTAGSLLFGPIGDRFGRKNALMIALLFNVVGLVLSATAQSAGQLGVWRLITGIGIGGILACITVVISEFSNNKNRGMAMSIYAAGYGIGASLGGFGAAQLIPTFGWRSVFAAGAIATGIATIATFFFLPESVDWLSTRRPAGARDKINYIARRLGKVGTFELPGEQSLSTKKAGLQSYAVLVNKENRGTSIKLWVAFGIVMFGFYFANTWTPKLLVETGMSEQQGIIGGLMLSMGGAFGSLLYGFLTTKFSSRNTLMTFMVLSGLTLILFISSTSVPSIAFASGVVVGMLINGCVAGLYTLSPQLYSAEVRTTGVGAAIGMGRVGAISAPLLVGGLLDSGWSPTQLYVGVAVIVIAGATALIGMRTQAVAVEKQPEALATK

SEQ ID NO: 603 - DNA, 813 bp, Corynebacterium glutamicum
  CDS (101)..(790): RXN00661
cggatgcaagagaaccgtggtttcgctgatttttggcgaacccggaattaaggccccgaggattacatgcttttaaatcctttgaaaaggggacaagatcatgaatcctataaccgaattattagacgcaacactatggatcggcggagttccgattctgtggcgcgaaatcatcggcaacgttttcggattatttagcgcgtgggcaggaatgcgacgcatcgtgtgggcatggcccatcggcatcataggcaacgcgctgctgttcacagtatttatgggcggccttttccacactccacaaaacctcgatctctacggccaagcgggtcgccagatcatgttcatcatcgtcagtggttatggctggtaccaatggtcggccgcaaaacgtcgcgcactcaccccagaaaatgcagtagcagtggttcctcgctgggcaagcaccaaagaacgcgccggcattgtgattgcggcggttgtgggaacactcagctttgcctggattttccaagcactcggctcctgggggccatgggccgacgcgtggattttcgtcggctcaatcctggctacctacggaatggctcgcggatggacagagttctggctgatctggatcgccgtcgacatagttggcgttcctctacttttgactgctggctactacccatccgcggtgctttacctggtgtacggtgcgtttgtcagctggggatttgtcgtgtggctgcgggtgcaaaaagcagacaaggctcgtgcgctggaagctcaggagtctgtgacagtctgaaaagcgtttactaaatagaa

SEQ ID NO: 604 - protein, 230 aa, Corynebacterium glutamicum
MNPITELLDATLWIGGVPILWREIIGNVFGLFSAWAGMRRIVWAWPIGIIGNALLFTVFMGGLFHTPQNLDLYGQAGRQIMFIIVSGYGWYQWSAAKRRALTPENAVAVVPRWASTKERAGIVIAAVVGTLSFAWIFQALGSWGPWADAWIFVGSILATYGMARGWTEFWLIWIAVDIVGVPLLLTAGYYPSAVLYLVYGAFVSWGFVVWLRVQKADKARALEAQESVTV

SEQ ID NO: 605 - DNA, 1332 bp, Corynebacterium glutamicum
  CDS (101)..(1309): RXN02566
gactccggatgatcaagcagcgaaacctttgtcaagaacatagctccccaccctagacaaaagcccaaataaatctgctcaataacctaacctaaagtccatgcacgcctcgtcgccccaacctcaccctcagcgcacccgtgttctcagcggcctgattttcgcccaaatcatggttggtgcatccaatggcgtgacgctatcgatgggaagtttgctggcagcacacttggcgggagcttcgtggggaggatcagccgccacattgaccacgatcggcgcagctatcttttcgattccccttgcccgcatggtctccacatacgatcgccgaacttcactcagcacgggcatgttgcttggttgcgtgggcgcactactggcgatcctcggcgcacaattcggcttgtttccagtagtacttttggcatttttgttcctcggatccatgtcggcggttaacctccaagcacgtttcgccgcaaccgacgtggccagtgaagaaacccgcggccgcgacctctcgatcgttgtgtggtccaccaccatcggcgcaatcgccggaccaaatttatttgaaccaagcgcccgattcagcgaaaccctgggcctcgaacaacatgccggcgcatacctgctgtgtttatttggccagctcatcgccatcgcagtctggcgattcaccctccccaaaggcctcaaacccgaagccaccccaaatgcaccaacagaaaagaagcgcctcaccccgaaagccctccaagccatcacatcggttgcaaccgcacacttctccatggtcggtctcatgtccatggccgccatccacatgcaaggccacggcgccagcctcaccatcatcggcttcaccatcagtttgcacgtcgccggaatgtacgcactctcaccagtgttcggcctgctcacagacaaactcggccgcaatgtcaccatctattccggcttcgccatgctcgccacatccgcagcatttcttatcatttggcccgaaccacagtgggccatgatcacatccatgatcctgcttgggctcggctggaactctgccctcgtcggttcttcaacattgcttgtcgacgccacccccatccaccaccgcacctacgcccaggggcgcagcgacctaacgatgaatcttgcgggagcttcaggcgggttgatcgccggaccgttaattgccatgggcggaatgcccttgttggcaggcgtcgttcttgcagttgtggcgcttcaaacggtgcttagtttcagaacccgttcaattgaaaagactcctgcttcatgtttttagcctaggaattcacgcacgac

SEQ ID NO: 606 - protein, 403 aa, Corynebacterium glutamicum
MHASSPQPHPQRTRVLSGLIFAQIMVGASNGVTLSMGSLLAAHLAGASWGGSAATLTTIGAAIFSIPLARMVSTYDRRTSLSTGMLLGCVGALLAILGAQFGLFPVVLLAFLFLGSMSAVNLQARFAATDVASEETRGRDLSIVVWSTTIGAIAGPNLFEPSARFSETLGLEQHAGAYLLCLFGQLIAIAVWRFTLPKGLKPEATPNAPTEKKRLTPKALQAITSVATAHFSMVGLMSMAAIHMQGHGASLTIIGFTISLHVAGMYALSPVFGLLTDKLGRNVTIYSGFAMLATSAAFLIIWPEPQWAMITSMILLGLGWNSALVGSSTLLVDATPIHHRTYAQGRSDLTMNLAGASGGLIAGPLIAMGGMPLLAGVVLAVVALQTVLSFRTRSIEKTPASCF

SEQ ID NO: 607 - DNA, 760 bp, Corynebacterium glutamicum
  CDS (101)..(760): FRXA02561
atctgctcaataacctaacctaaagtccatgcacgcctcgtcgccccaacctcaccctcagcgcacccgtgttctcagcggcctgattttcgcccaaatcatggttggtgcatccaatggcgtgacgctatcgatgggaagtttgctggcagcacacttggcgggagcttcgtggggaggatcagccgccacattgaccacgatcggcgcagctatcttttcgattccccttgcccgcatggtctccacatacgatcgccgaacttcactcagcacgggcatgttgcttggttgcgtgggcgcactactggcgatcctcggcgcacaattcggcttgtttccagtagtacttttggcatttttgttcctcggatccatgtcggcggttaacctccaagcacgtttcgccgcaaccgacgtggccagtgaagaaacccgcggccgcgacctctcgatcgttgtgtggtccaccaccatcggcgcaatcgccggaccaaatttatttgaaccaagcgcccgattcagcgaaaccctgggcctcgaacaacatgccggcgcatacctgctgtgtttatttggccagctcatcgccatcgcagtctggcgattcaccctccccaaaggcctcaaacccgaagccaccccaaatgcaccaacagaaaagaagcgcctcaccccgaaagccctccaagccatcacatcggttgcaaccgcacacttctccatggtcggtctcatgtccatggccgccatccacatg

SEQ ID NO: 608 - protein, 220 aa, Corynebacterium glutamicum
MVGASNGVTLSMGSLLAAHLAGASWGGSAATLTTIGAAIFSIPLARMVSTYDRRTSLSTGMLLGCVGALLAILGAQFGLFPVVLLAFLFLGSMSAVNLQARFAATDVASEETRGRDLSIVVWSTTIGAIAGPNLFEPSARFSETLGLEQHAGAYLLCLFGQLIAIAVWRFTLPKGLKPEATPNAPTEKKRLTPKALQAITSVATAHFSMVGLMSMAAIHM

SEQ ID NO: 609 - DNA, 461 bp, Corynebacterium glutamicum
  CDS (1)..(438): FRXA02566
atcagtttgcacgtcgccggaatgtacgcactctcaccagtgttcggcctgctcacagacaaactcggccgcaatgtcaccatctattccggcttcgccatgctcgccacatccgcagcatttcttatcatttggcccgaaccacagtgggccatgatcacatccatgatcctgcttgggctcggctggaactctgccctcgtcggttcttcaacattgcttgtcgacgccacccccatccaccaccgcacctacgcccaggggcgcagcgacctaacgatgaatcttgcgggagcttcaggcgggttgatcgccggaccgttaattgccatgggcggaatgcccttgttggcaggcgtcgttcttgcagttgtggcgcttcaaacggtgcttagtttcagaacccgttcaattgaaaagactcctgcttcatgtttttagcctaggaattcacgcacgac

SEQ ID NO: 610 - protein, 146 aa, Corynebacterium glutamicum
ISLHVAGMYALSPVFGLLTDKLGRNVTIYSGFAMLATSAAFLIIWPEPQWAMITSMILLGLGWNSALVGSSTLLVDATPIHHRTYAQGRSDLTMNLAGASGGLIAGPLIAMGGMPLLAGVVLAVVALQTVLSFRTRSIEKTPASCF

SEQ ID NO: 611 - DNA, 1527 bp, Corynebacterium glutamicum
  CDS (101)..(1504): RXA00051
cagtaaaagtgcaccgacactaagaatccttatccttcagagtaaggtgatctgcgtcaaaaaatgtccgctattcacccgaaacgaggtcagcatctcgatgaatgcctcccctgccccaacccgatcttttaaaggattgcgggctcgacacattcacttcatcgcgctgggttccgcgatcggcaccggcttgttctacggttccgctggcgcaatccaagcagctggtccatctgtactcttggtctaccttctcggtggcgccgtcgtgtacttcatgctgcgcgcactcggcgagatggctgtgcatcacccagtccgtggttccttcgcggtctacacccgcgcacaccttggcggatgggcaggctacatcaccggctggatgttcgcgtttgagatgctcatcgtctgcctggctgacctcacagccatcggcatctatatgaacttctggttccccggcaccccacaatggacttgggtggtagccacccttcttattgtcggtggcgcaaacctcgcatcagtgcgttggttcggtgagctcgagttcatcttcaccatcattaaggtcaccgcagttgtcgccatgatcgtcggcggcgcagccatcctcgcattcggtctcggcgccaacgctgaagttgccggcgtatccaacctctgggagcacggcggattcttccccaacggtgttgaaggcatgatcgcagccttcatccttgttctcttcgcattcggtggcaccgaaatcatcggtgttgcaggctctgaagctgaagatcctgagaagtccatccccaaggctgttaatactgtcccagtacgcatcctcctcttctatgtgggtgccatcctggtgatccttgcccttaatccttggccttccatcaccggcgaagaatccccattcgtccagatcttcgacaccctcggcgtcaactgggctgctggtctcctcaacgccgtggtcatcaccgctgcactgtctgccatcaacgctgacctcttcggcgctggccgcgttctcactggtcttgcgaaggaaaacctcgcaccaaaggccatgggcaagatcgccaagaacggcgttccagtcatgaccaccaccatcatgatcatcgtcttgatcgtgggagtaatcctcaacgcagtgcttcccgagcgcgtcttcgagatcgtcgcttccctagcaaccttcgccacagtttacgtctggctgatgatcctgctcgcacaggtgggatcccgccgaaacatgcctgccgacgaggtcaagtccctgaagttccctgtccccttctaccccttcggacaatacttcgcgatcctatttatcgccttcaccttcggcatcatggtctggtacgacaactaccacctgccactcgccgtcggcgttggattccttgtcctgatgacaatcctttactacgccacaggccgaccaaaggcgatcgctccgatcgattatgaagagctagatccgcgacgcgattaatctagactcgcacgaaaaag

SEQ ID NO: 612 - protein, 468 aa, Corynebacterium glutamicum
MNASPAPTRSFKGLRARHIHFIALGSAIGTGLFYGSAGAIQAAGPSVLLVYLLGGAVVYFMLRALGEMAVHHPVRGSFAVYTRAHLGGWAGYITGWMFAFEMLIVCLADLTAIGIYMNFWFPGTPQWTWVVATLLIVGGANLASVRWFGELEFIFTIIKVTAVVAMIVGGAAILAFGLGANAEVAGVSNLWEHGGFFPNGVEGMIAAFILVLFAFGGTEIIGVAGSEAEDPEKSIPKAVNTVPVRILLFYVGAILVILALNPWPSITGEESPFVQIFDTLGVNWAAGLLNAVVITAALSAINADLFGAGRVLTGLAKENLAPKAMGKIAKNGVPVMTTTIMIIVLIVGVILNAVLPERVFEIVASLATFATVYVWLMILLAQVGSRRNMPADEVKSLKFPVPFYPFGQYFAILFIAFTFGIMVWYDNYHLPLAVGVGFLVLMTILYYATGRPKAIAPIDYEELDPRRD

SEQ ID NO: 613 - DNA, 1578 bp, Corynebacterium glutamicum
  CDS (101)..(1555): RXA01172
taaatttttctagactacccagattaagtgagattctttcgtgtcttcgacaacttcgacaacttcggccacccgacaagagccgttgagcccgacgggtgtgcttgcctcgtttaggttcgcgtttagtagcccgcggaggtttcgcaccgaggttttagctggcctcgtggtggcgctcgcgctgattccggagtcgattgcgttttccgtattagctggcgtggatcctaagatgggtctttttgcgtcgtgcaccatggcaatgaccattgcgcttacaggtggacgccctgcgatgatttccgcggcgacaggcgctgtggcgctggtgattgcaccggtggttcgggatcatggcgtggaatatttcctggccacggtaattttggcgggcattattcagattgcgttgtcgttgctgggtgtagccaagctgatgcggttcattccgcgttccgttatgctcggatttgttaatgcgctggcgtgcttggtgttttttgcgcagctgccgcacctgatcgatgttccgtggatggtgtatccgctgttcgcgctgggtattggcatcatgctgttttggccgaagctgacctcggtgattccggctccgctgattgttatcgtggccttgactgcgatcgtgtgggttttcggaatcaacattccaaacgtctctgaccagggcgaactcccctcttccctaccagaattcctcattcccaacgttccgcttactcttgagactctaaaaattattgggccgtatgcgcttggaatgtcgcttgttgggttgatggaatcgctgctgaccgccaagctggtcgatgatattacggaggttcactccaataaatcccgcgaagctgcaggtcagggcatcgcaaacattatcaccgcgtttttgggcggcatgggtggctgcgcgatgatcggccagaccatgatcaacgtgaaaaactcaggagcccgcactcgcctatccaccttcttggccggcggcttcctgctgctcctggtggttttgctgggcgatgtcgtgggcaaaatccccatggcggcgctcgtggcagtcatgattatcgtctccatcgacaccgccgactggcattcgctgaacccgcgcaccctcaaattcatgccgctgagtgaaacgatcgtcatgtttataacgatcatcgcgaccctcgtcaccggaaacctggcgatcggcgtcatcctcggagtgctcaccgccatggtcatgtttgctcgccgcgtggcccacctcgtgtctgtggagcgcaccaccgacaacaacatcagcacctataccgtcaagggccagctattttgggcgtcctcgaacgatatggtgtactccttcgactactccgacgaggccgagcagatcatcatcgatctcaccgccgcagaaatctgggacgcctccacggtagccacgctggacagcatcatccacaaatacgccgcgcgcggcaagagcgtggagatcatcgggctcgacggccccagccgcgataggcttgagcgcctatcaggcaagctgggctaaaaatttgcttatcgacgcgc

SEQ ID NO: 614 - protein, 485 aa, Corynebacterium glutamicum
VLASFRFAFSSPRRFRTEVLAGLVVALALIPESIAFSVLAGVDPKMGLFASCTMAMTIALTGGRPAMISAATGAVALVIAPVVRDHGVEYFLATVILAGIIQIALSLLGVAKLMRFIPRSVMLGFVNALACLVFFAQLPHLIDVPWMVYPLFALGIGIMLFWPKLTSVIPAPLIVIVALTAIVWVFGINIPNVSDQGELPSSLPEFLIPNVPLTLETLKIIGPYALGMSLVGLMESLLTAKLVDDITEVHSNKSREAAGQGIANIITAFLGGMGGCAMIGQTMINVKNSGARTRLSTFLAGGFLLLLVVLLGDVVGKIPMAALVAVMIIVSIDTADWHSLNPRTLKFMPLSETIVMFITIIATLVTGNLAIGVILGVLTAMVMFARRVAHLVSVERTTDNNISTYTVKGQLFWASSNDMVYSFDYSDEAEQIIIDLTAAEIWDASTVATLDSIIHKYAARGKSVEIIGLDGPSRDRLERLSGKLG

SEQ ID NO: 615 - DNA, 1818 bp, Corynebacterium glutamicum
  CDS (101)..(1795): RXA02128
tattagcaaaacttcttaaagagcctttttgtgcctttatccgagtatctttaaaagcatgagtattaagtgggcgcgctttgtaccggggataaccgcgatgcggggctatcaacgatcctggttgaagggtgatgtcatcgcgggtataaccgtggccgcgtacttggttccacaagtcatggcttatgccgtcattgcggggctgccagctgtcgttggtctgtggggagttctggctcccatggcgctgtactttttcttgggcacgtctcgaaatctctcggttggtcctgaatcaaccaccgctctgatgacggctgcaggtgtgggagctttagtcggggcagctggcgggcctgaacgatacgcagaagtagcggcactattggctattgcagtgggcattgtatgcgctgttggttttattggccgattgggatttcttaccaggctgttgtctcgaccggtgctcgttggatatttgatcggtattgcagtcttgatgatcgtcagtcagctgtccaaagtcacccaggtgaatgtggagagcggtcagacgtggcaggaaataatatcgtttatcaaagtagctggccaggcacatattcctacagtgattttggcagtcgtggtgttgagcttgctgtatctggcaaattggttgacgcctaaatttcccagcacactcatggttcttctgctttcggcagccgcggtggggttttttcatctggataggtttggtcttgaggtcattggtgaggtgccccgtggcctgcctcaaccaagtattccctcgattggcgatctagagatctggtcgttgttgccctatgccgtgggtattgccatcgttggtttttcagacaatgtgttgactgctcgtgcattcgcgtcgggaaaagatgaggtgattgattccaaccaggagctgctcgcactgggaaccgcaaacctggcgaatgggttcttccagggatttcctgtgtcatcgagtggctcccgaactgttcttggagacacggcaggtgctcgcactcaggtgcattcacttgtcgtggtggcgctggtgatcatggtgctgttgtttgctggtcctgtgctcgagtctttcccagatgcggcacttggcgccttagttatttatgcagcaacgcagttgattgatatcgcagagatcaaaaggatcgcacgtttccgcaagagcgagttggtcatcacagcggctactgctgcatccgttgtggcttctggcgtgctcgcggggatcggcgttgcggttacgttgtccatcttggatctcatcagacgtattacccgaccttatgccgatgtcctaggatatacgccgggcatggctggaatgcacagcttggaggattatcctgagtcgacagcagtcgaagggctcgtggtttttagatacgattccccactgtttttcgccaacgctgatgatttttccaaacgtgccatcgaagccgttgatgaagcaactcaacccgtgcattggtttttactgaatgctgaagcgaatacggaagttgatctcacggccgtcgatgccatggaagcacttcgcaaaaccctggaggaacggggtatccgatttgcgatggcccgggtgaagcaagatctacgccgaagcctcgagcctgcaggtttcattgaatccgtgggggaggagtacattttcgccacactccccactgcagtcaaggggtattccgtggagtttcgcgatcgttttggaaactatccagaaggcgttccgaaagaaattttggaactttaagctgcctggttggcggactt

SEQ ID NO: 616 - protein, 565 aa, Corynebacterium glutamicum
MRGYQRSWLKGDVIAGITVAAYLVPQVMAYAVIAGLPAVVGLWGVLAPMALYFFLGTSRNLSVGPESTTALMTAAGVGALVGAAGGPERYAEVAALLAIAVGIVCAVGFIGRLGFLTRLLSRPVLVGYLIGIAVLMIVSQLSKVTQVNVESGQTWQEIISFIKVAGQAHIPTVILAVVVLSLLYLANWLTPKFPSTLMVLLLSAAAVGFFHLDRFGLEVIGEVPRGLPQPSIPSIGDLEIWSLLPYAVGIAIVGFSDNVLTARAFASGKDEVIDSNQELLALGTANLANGFFQGFPVSSSGSRTVLGDTAGARTQVHSLVVVALVIMVLLFAGPVLESFPDAALGALVIYAATQLIDIAEIKRIARFRKSELVITAATAASVVASGVLAGIGVAVTLSILDLIRRITRPYADVLGYTPGMAGMHSLEDYPESTAVEGLVVFRYDSPLFFANADDFSKRAIEAVDEATQPVHWFLLNAEANTEVDLTAVDAMEALRKTLEERGIRFAMARVKQDLRRSLEPAGFIESVGEEYIFATLPTAVKGYSVEFRDRFGNYPEGVPKEILEL

SEQ ID NO: 617 - DNA, 1734 bp, Corynebacterium glutamicum
  CDS (101)..(1711): RXA02634
caacgcgaaggcttagttgtttattaccggctcacctacccggaggtcgcagactttcttaaggtgagccgctcactattaaagaggatggctggcgaagatgcgtgaccttttaccctctagagacgactatcagctactccgcttctcctggaagatggacattgctgctggcgtcaccgtgggcattgttgccctccccctcgctctcgcctttggtgtgagttctggagtcggagccgaggcaggattagtgactgcgattattgctggcctggttgcagcaatcttcggcggttccaatgtgcaggtttcaggaccaacaggagcgatggtggttgttctcgctccaatcgtcgcccaatatggtgtcggtgcggttgcattactcagcctgatggctggagttatcgtccttgtcgccggagtgcttcgattaggccgaacggtgagtttcattccgtggccggtcatcgaaggatttacggcaggcatcggtgtgattattttcctgcaacaggtgccagctgcgtttggttattcgggccatttgcccaccaatgcgctcctcgctgcgattcacactgtttcacacgccacgaaggacgcaattctacctctcttaattattatcgtcaccgctgcgatcatgattgtgttgggaaagatcgccccaaagctccctgccagcttcattgccattttggtggtgtccattggcgtggctctgctcaagcttcccgttgagttgatcggtgagctccccaattcccttcctgcccctcacctgcctgatgtgaacctggagatgttcacgagtttgctggggccagcttttgctgtcgccgcgctcgctgctattgagtctctcctttccgctcgtgtggcagcctccatggccgatacgggtccttataatgctgaccgcgaattggtcggtcaggggttggcgtcgataagcgctggcttttttggcggcatgccggcaactggcgcaatcgcgcgtacggcggtcaatgtgcgctccggcgggcgtacccgtatagcgtcgattattcacgcgcttgtgctgctcggcgttgtgtatgtggcggcgaatatcgttgcggtcattccgctcgccgcactgtcgggcgtgctcatggtcaccgcgagccgcatggtgtccattgaagtgatctcgcgcgtcatgcgctccactcgctctgatgcgatcgtttttgtcatcaccgcgatcgtcaccatcagcgtcgacctcgtcattgcggtcggcatcggcattgccgtcgcgacgttcttcatgctgcgacgcatgagcatgaacgccggcgtcttccgggaaaccttgcccgaaccggccacgcttaacgacgaaaagatcggccttttccgtatcgagggcgcattgttctttggcgcagctgaacgtctttcgcagcaaatccttgattatgaggacctcgaagtggtgatcctgcgcctgtcacacatccaaatgatcgacgccaccggcgcccaccagctcaccgagcttgtcaatgcgctggaaagaaaaaatgtcactgtattaattaagggcgtccggaaagaacacattcacgttctcggcgtcctcggagcgatcagatcactgcggcatgagaaccacctcttcgatgaccttgccccagcggttgaacatgcccgaaaacacgttaagatcgacaacagttaaggcttccggggcgatctaaa

SEQ ID NO: 618 - protein, 537 aa, Corynebacterium glutamicum
MRDLLPSRDDYQLLRFSWKMDIAAGVTVGIVALPLALAFGVSSGVGAEAGLVTAIIAGLVAAIFGGSNVQVSGPTGAMVVVLAPIVAQYGVGAVALLSLMAGVIVLVAGVLRLGRTVSFIPWPVIEGFTAGIGVIIFLQQVPAAFGYSGHLPTNALLAAIHTVSHATKDAILPLLIIIVTAAIMIVLGKIAPKLPASFIAILVVSIGVALLKLPVELIGELPNSLPAPHLPDVNLEMFTSLLGPAFAVAALAAIESLLSARVAASMADTGPYNADRELVGQGLASISAGFFGGMPATGAIARTAVNVRSGGRTRIASIIHALVLLGVVYVAANIVAVIPLAALSGVLMVTASRMVSIEVISRVMRSTRSDAIVFVITAIVTISVDLVIAVGIGIAVATFFMLRRMSMNAGVFRETLPEPATLNDEKIGLFRIEGALFFGAAERLSQQILDYEDLEVVILRLSHIQMIDATGAHQLTELVNALERKNVTVLIKGVRKEHIHVLGVLGAIRSLRHENHLFDDLAPAVEHARKHVKIDNS

SEQ ID NO: 619 - DNA, 1410 bp, Corynebacterium glutamicum
  CDS (101)..(1387): RXN02233
atccccacccaattggcccaagagctgcagagttacgttgtagaacccacctctgcctaactgtcgatttcccaagagcccccttgggagtcgataattagtgctcgtgacttcaacatggggatggaccgtccacggagacggcaaaaagatcgaacccggcgcagttgtcgctcctaaagagcgcctgagctgggggcgcacaattggaatcggtatgcagcacgtgatcgccatgttcggcgccacgctcctggttcccacactcaccggatttccggtcaacaccacacttttattctctggtctgggaacaatcctgttcctgttgatcaccagaaaccgactaccctcgtacctgggtagttcttttgctttcattgcacctttaaccgcaacccaagtccatggcattggcgtgcagatcggtggcattcttgtcgcaggtctcgtgctcgtcgccattggatttgtggtgaaagcagcgggcaaacgcgttattgatgctgtcatgccacccgctgtcaccggtgcgatcgtggcactcatcggcctgaacctggcaccaaccgcggcaggaaacttctccagccaaccactggttgccacggcgaccctctttgccattttgatcgctaccgttgcaggccgcggaatgattgctcgcctgggcattttgatcggtgtggtgatcggctgggttttcgcagctatcaccggcaacctctcagaaggcgcagcagacaccatccgtgaagcagcatggttcggactgccacagttccacaagccggaattccagctctctgccattttggtgacactgccagtcatcatcgtgctcatcgctgaaaacgtcggccacgtcaaagcagtctcagagatgacaggggaggacctcgacgacctcgccggcgacgcacttatcgcagacggattcggcaccaccctcgcaggtgccttcggtggatccggcaccaccacctacgcagaaaacatcggcgtcatggcggccacccgcgtatattccaccgctgcgtactgggttgccgcgtgcactgccatcgcccttgccttcatccccaaattcggtgcactgatcttcaccatccccgccggcgtgctgggtggggcatgtttggttctttacggcctaatcggtatgctcggcattcgtatctggcaagacaacaaggtcaacttcaacaatccagtgaatctgaccatggctgccgttgctttggttgcaggcattggtaacctcaccctcaccgttttcggagtcactcttgaaggcatcgcatggggctctgtaggcatcattgtgctgtacccaatcatgaagcgcctgtacctttccattggggaaggcaagaacgcaaagttctagtacgctgctaaagtatgcag

SEQ ID NO: 620 - protein, 429 aa, Corynebacterium glutamicum
VLVTSTWGWTVHGDGKKIEPGAVVAPKERLSWGRTIGIGMQHVIAMFGATLLVPTLTGFPVNTTLLFSGLGTILFLLITRNRLPSYLGSSFAFIAPLTATQVHGIGVQIGGILVAGLVLVAIGFVVKAAGKRVIDAVMPPAVTGAIVALIGLNLAPTAAGNFSSQPLVATATLFAILIATVAGRGMIARLGILIGVVIGWVFAAITGNLSEGAADTIREAAWFGLPQFHKPEFQLSAILVTLPVIIVLIAENVGHVKAVSEMTGEDLDDLAGDALIADGFGTTLAGAFGGSGTTTYAENIGVMAATRVYSTAAYWVAACTAIALAFIPKFGALIFTIPAGVLGGACLVLYGLIGMLGIRIWQDNKVNFNNPVNLTMAAVALVAGIGNLTLTVFGVTLEGIAWGSVGIIVLYPIMKRLYLSIGEGKNAKF

SEQ ID NO: 621 - DNA, 1335 bp, Corynebacterium glutamicum
  CDS (101)..(1312): FRXA02233
atccccacccaattggcccaagagctgcagagttacgttgtagaacccacctctgcctaactgtcgatttcccaagagcccccttgggagtcgataattagtgctcgtgacttcaacatggggatggaccgtccacggagacggcaaaaagatcgaacccggcgcagttgtcgctcctaaagagcgcctgagctgggggcgcacaattggaatcggtatgcagcacgtgatcgccatgttcggcgccacgctcctggttcccacactcaccggatttccggtcaacaccacacttttattctctggtctgggaacaatcctgttcctgttgatcaccagaaaccgactaccctcgtacctgggtagttcttttgctttcattgcacctttaaccgcaacccaagtccatggcattggcgtgcagatcggtggcattcttgtcgcaggtctcgtgctcgtcgccattggatttgtggtgaaagcagcgggcaaacgcgttattgatgctgtcatgccacccgctgtcaccggtgcgatcgtggcactcatcggcctgaacctggcaccaaccgcggcaggaaacttctccagccaaccactggttgccacggcgaccctctttgccattttgatcgctaccgttgcaggccgcggaatgattgctcgcctgggcattttgatcggtgtggtgatcggctgggttttcgcagctatcaccggcaacctctcagaaggcgcagcagacaccatccgtgaagcagcatggttcggactgccacagttccacaagccggaattccagctctctgccattttggtgacactgccagtcatcatcgtgctcatcgctgaaaacgtcggccacgtcaaagcagtctcagagatgacaggggaggacctcgacgacctcgccggcgacgcacttatcgcagacggattcggcaccaccctcgcaggtgccttcggtggatccggcaccaccacctacgcagaaaacatcggcgtcatggcggccacccgcgtatattccaccgctgcgtactgggttgccgcgtgcactgccatcgcccttgccttcatccccaaattcggtgcactgatcttcaccatccccgccggcgtgctgggtggggcatgtttggttctttacggcctaatcggtatgctcggcattcgtatctggcaagacaacaaggtcaacttcaacaatccagtgaatctgaccatggctgccgttgctttggttgcaggcattggtaacctcaccctcaccgttttcggagtcactcttgaaggcatcgcatgggctctgtaggcatcattgtgctgtaccca

SEQ ID NO: 622 - protein, 404 aa, Corynebacterium glutamicum
VLVTSTWGWTVHGDGKKIEPGAVVAPKERLSWGRTIGIGMQHVIAMFGATLLVPTLTGFPVNTTLLFSGLGTILFLLITRNRLPSYLGSSFAFIAPLTATQVHGIGVQIGGILVAGLVLVAIGFVVKAAGKRVIDAVMPPAVTGAIVALIGLNLAPTAAGNFSSQPLVATATLFAILIATVAGRGMIARLGILIGVVIGWVFAAITGNLSEGAADTIREAAWFGLPQFHKPEFQLSAILVTLPVIIVLIAENVGHVKAVSEMTGEDLDDLAGDALIADGFGTTLAGAFGGSGTTTYAENIGVMAATRVYSTAAYWVAACTAIALAFIPKFGALIFTIPAGVLGGACLVLYGLIGMLGIRIWQDNKVNFNNPVNLTMAAVALVAGIGNLTLTVFGVTLEGIAWAL

SEQ ID NO: 623 - DNA, 2010 bp, Corynebacterium glutamicum
  CDS (101)..(1987): RXN02372
gacaatactgatggataaatttcatatcgaggacgaagggacaaccccgaacgccgtgacaacatcaaccacaacccgggtgaaacatccggtagaccaggtgccacccgcacccaaacttgcagccctagggctccaacacgttcttgctttctacgcaggagccgtcattgttccgctgctgattgcacagtcgctgaacttggacactgcgaccaccattcacctgattaacgctgacttgttgacatgtggcatcgccacgttgattcagtctgtgggcattggtcgccacattggtgtgcgcctaccgatcgttcaaggtgtcaccactactgctgttgctcccatcatcgccattggtttgggcgttactgatggtcaaggtggcgttgcgtcgctgcctgccatttacggtgcagtcattgtctccggcattttcacgttctttgcagcgccggtgtttgcgcgtttcctcaagttcttcccaccagttgtcaccggtactgtgctgttggttatgggtgcttccctgctgtcggtatctgcaaatgactttgtgaactacgccgatggggtgcctgctgcccgcgatcttgcttacggttttggcaccttggcggtgatcattttggcgcagcgcttcttccgtggattcatgggcaccttggctgtgttgatcggcctggttggtggcaccgcagttgctctgatcttgggcgatgccaacttggatgaggtgggaaatgctgaagcgttcgacatcaccactccgttttattttggtgttccagaatttaacgctgttgccattttctccatgattatcgtcatgatcatcaccatggtggagaccaccggtgatgtgtttgcaacgggggaaatcgtcggcaagcgaactcgccgcagtgatgtcacccgcgcactgcgcgctgacggcctgtccaccctgatgggtggcgtcatgaactccttcccgtacacgtgcttcgcgcaaaacgttggcctggtgcgcatcacgggcgtgaaatctcgctgggttgcggcagctgctgccggcttcatgatcatcctcggtgtgctgcccaaggctggcgcgatcgtcgcttccatcccttccccagtcctcggtggcgcatccttggcactgttcgccaacgttgcatgggtgggcatccagaccatcgccaagtctgacctcgctgatagccgcaactccgtcatcgtgacctccgcacttggcctagccatgctggtgtccttccgccccgatgttgctcaggcgttccctgagtgggcgcgtatcttcgtctcctccggcatgtccgtcggcgcgatcaccgcgatcctgcttaacctgctgttcttccacgtcggacgccaatccggtggacaagtcgctacctcaaaatccggtgagcgcatcaatttggatgcggtcaacaagatggatcgcaccgacttcgtagaaaccttcgcaccgctgttcaacagcaagacctggcctttggaaaccgcatgggaatcccagccattcgccaacgtcacggaactgcgcgaagccatccaagtcgctgtgctcaccgcaccgttgtccgaccgcgaagagctcatccacgactaccccgacatggcacagctcattttggccaccgaagaggaagccgccaccatctctcaagaccgtggttcgatcggtcttgatgatctcgatgacgtggatcaagaaaagctcatcaccgtcaccgagcagtaccgcgaacggttcaacatgccgtatgttgcgtacttcgacaccatggattctgtggataccgtcgtagccgccggcttgcgccgcctcgacaactccgacgagcaggagcaccgccaagcgctatcggaaatcattgagattgccaatgaccgcttcgatatattgcttgccgacgctaacccagcccgttcagctttcgatcgcaagtttaccgagactgacttcctcggctaaaacaccaaaaacaaattaag

SEQ ID NO: 624 - protein, 629 aa, Corynebacterium glutamicum
VPPAPKLAALGLQHVLAFYAGAVIVPLLIAQSLNLDTATTIHLINADLLTCGIATLIQSVGIGRHIGVRLPIVQGVTTTAVAPIIAIGLGVTDGQGGVASLPAIYGAVIVSGIFTFFAAPVFARFLKFFPPVVTGTVLLVMGASLLSVSANDFVNYADGVPAARDLAYGFGTLAVIILAQRFFRGFMGTLAVLIGLVGGTAVALILGDANLDEVGNAEAFDITTPFYFGVPEFNAVAIFSMIIVMIITMVETTGDVFATGEIVGKRTRRSDVTRALRADGLSTLMGGVMNSFPYTCFAQNVGLVRITGVKSRWVAAAAAGFMIILGVLPKAGAIVASIPSPVLGGASLALFANVAWVGIQTIAKSDLADSRNSVIVTSALGLAMLVSFRPDVAQAFPEWARIFVSSGMSVGAITAILLNLLFFHVGRQSGGQVATSKSGERINLDAVNKMDRTDFVETFAPLFNSKTWPLETAWESQPFANVTELREAIQVAVLTAPLSDREELIHDYPDMAQLILATEEEAATISQDRGSIGLDDLDDVDQEKLITVTEQYRERFNMPYVAYFDTMDSVDTVVAAGLRRLDNSDEQEHRQALSEIIEIANDRFDILLADANPARSAFDRKFTETDFLG

SEQ ID NO: 625 - DNA, 578 bp, Corynebacterium glutamicum
  CDS (1)..(555): FRXA02372
gatgcggtcaacaagatggatcgcaccgacttcgtagaaaccttcgcaccgctgttcaacagcaagacctggcctttggaaaccgcatgggaatcccagccattcgccaacgtcacggaactgcgcgaagccatccaagtcgctgtgctcaccgcaccgttgtccgaccgcgaagagctcatccacgactaccccgacatggcacagctcattttggccaccgaagaggaagccgccaccatctctcaagaccgtggttcgatcggtcttgatgatctcgatgacgtggatcaagaaaagctcatcaccgtcaccgagcagtaccgcgaacggttcaacatgccgtatgttgcgtacttcgacaccatggattctgtggataccgtcgtagccgccggcttgcgccgcctcgacaactccgacgagcaggagcaccgccaagcgctatcggaaatcattgagattgccaatgaccgcttcgatatattgcttgccgacgctaacccagcccgttcagctttcgatcgcaagtttaccgagactgacttcctcggctaaaacaccaaaaacaaattaag

SEQ ID NO: 626 - protein, 185 aa, Corynebacterium glutamicum
DAVNKMDRTDFVETFAPLFNSKTWPLETAWESQPFANVTELREAIQVAVLTAPLSDREELIHDYPDMAQLILATEEEAATISQDRGSIGLDDLDDVDQEKLITVTEQYRERFNMPYVAYFDTMDSVDTVVAAGLRRLDNSDEQEHRQALSEIIEIANDRFDILLADANPARSAFDRKFTETDFLG

SEQ ID NO: 627 - DNA, 1314 bp, Corynebacterium glutamicum
  CDS (101)..(1291): FRXA02377
gacaatactgatggataaatttcatatcgaggacgaagggacaaccccgaacgccgtgacaacatcaaccacaacccgggtgaaacatccggtagaccaggtgccacccgcacccaaacttgcagccctagggctccaacacgttcttgctttctacgcaggagccgtcattgttccgctgctgattgcacagtcgctgaacttggacactgcgaccaccattcacctgattaacgctgacttgttgacatgtggcatcgccacgttgattcagtctgtgggcattggtcgccacattggtgtgcgcctaccgatcgttcaaggtgtcaccactactgctgttgctcccatcatcgccattggtttgggcgttactgatggtcaaggtggcgttgcgtcgctgcctgccatttacggtgcagtcattgtctccggcattttcacgttctttgcagcgccggtgtttgcgcgtttcctcaagttcttcccaccagttgtcaccggtactgtgctgttggttatgggtgcttccctgctgtcggtatctgcaaatgactttgtgaactacgccgatggggtgcctgctgcccgcgatcttgcttacggttttggcaccttggcggtgatcattttggcgcagcgcttcttccgtggattcatgggcaccttggctgtgttgatcggcctggttggtggcaccgcagttgctctgatcttgggcgatgccaacttggatgaggtgggaaatgctgaagcgttcgacatcaccactccgttttattttggtgttccagaatttaacgctgttgccattttctccatgattatcgtcatgatcatcaccatggtggagaccaccggtgatgtgtttgcaacgggggaaatcgtcggcaagcgaactcgccgcagtgatgtcacccgcgcactgcgcgctgacggcctgtccaccctgatgggtggcgtcatgaactccttcccgtacacgtgcttcgcgcaaaacgttggcctggtgcgcatcacgggcgtgaaatctcgctgggttgcggcagctgctgccggcttcatgatcatcctcggtgtgctgcccaaggctggcgcgatcgtcgcttccatcccttccccagtcctcggtggcgcatccttggcactgttcgccaacgttgcatgggtgggcatccagaccatcgccaagtctgacctcgctgatagccgcaactccgtcatcgtgacctccgcacttggcctagccatgctggtgtccttccgccccgatgttgctcaaggcgttccctgagtgggcgcgtatcttcgtct

SEQ ID NO: 628 - protein, 397 aa, Corynebacterium glutamicum
VPPAPKLAALGLQHVLAFYAGAVIVPLLIAQSLNLDTATTIHLINADLLTCGIATLIQSVGIGRHIGVRLPIVQGVTTTAVAPIIAIGLGVTDGQGGVASLPAIYGAVIVSGIFTFFAAPVFARFLKFFPPVVTGTVLLVMGASLLSVSANDFVNYADGVPAARDLAYGFGTLAVIILAQRFFRGFMGTLAVLIGLVGGTAVALILGDANLDEVGNAEAFDITTPFYFGVPEFNAVAIFSMIIVMIITMVETTGDVFATGEIVGKRTRRSDVTRALRADGLSTLMGGVMNSFPYTCFAQNVGLVRITGVKSRWVAAAAAGFMIILGVLPKAGAIVASIPSPVLGGASLALFANVAWVGIQTIAKSDLADSRNSVIVTSALGLAMLVSFRPDVAQGVP

SEQ ID NO: 629 - DNA, 1512 bp, Corynebacterium glutamicum
  CDS (101)..(1489): RXA02676
aaccattgggtattaagaaatttgtggcttagatctcaatttctgtatagtttgatcatactaattcatccacttccaaattttcacgaaggatcaccccatggacacctgggaacaaacccttggaacagggccactgctaggcattgcagccggcgccattgccctcatcttggttctcgtcatcgtttttaaactccatgcttttctcaccctaatactggtttcaattgttaccgcacttgctgccggcattcccgtcaccgcagtagtggacactctccttgacggttttggtaaaacactcgcctcggtcgccctattggtaggcctgggtgccatgcttggtcgattggttgaaacatccggtggcgcaaaatctctagccgacactatggtgcgaatcttcggtgaaaaacgagcagctttcgcactcggtgtcgcatcgctgatcatgggattccctatcttcttcgatgctggcctcgtggtcatgctcccagtgatcttcgcagtagctcgacgcctcaacggctccgtccttacttttggtatccctgcagctggcgccttctctgtcatgcacgtgttcgtcccacctcacccaggcccaattgcagcctctgaattcttcggcgcacaagttggatacgtactaatcgctggcatcatcgttgcactacccacctggtatttaaccggttacctgctaggtaagttcttaggccgaaagttcccccttcccgtacccgatctactcagtggtggagcacaggaagatgatcagcctcagaacccagctaacgcagtgtcgatcattgtcattttgctcattcctatgctccttatttttggcaataccggaacatcaatggcagtttccgccggcctcctagatgcagaatccaccatggtgaaaattctaggattcctcggcgaaacaccagtggcactgctcattaccttgatcattgccctgttcttcctaggcaaccgacgtggcattaatggttctgctctagagaaaaccatcgaaggcgcactcggcccaatctgttcagtcgtattaatcactggcgccggtggcatgttcggtggagtgctacgcacgtctggaattggaggagcgcttgcagactccatggcagatctaggacttccagttatcgcaggttgtttcatcgtggcagccgtccttcgtgtcgcgcagggttctgccaccgttgcgctaaccaccgccgcagcactcatggcacctgctgttgccgctgctgactttaacgaattccagcttgctgccatcgttatttccactgccgctggttctgttattgccagccacgtcaacgactccggattctggctcgttggtcgactcatgaacgccgacgtacccaccacgctaaaaacttggaccgtaaaccaaacctgcattgcgattgtgggatttgtgatggcctatgcaatgttcggattggcatcgcttgcatagtccgctgaccccattgattc

SEQ ID NO: 630 - protein, 463 aa, Corynebacterium glutamicum
MDTWEQTLGTGPLLGIAAGAIALILVLVIVFKLHAFLTLILVSIVTALAAGIPVTAVVDTLLDGFGKTLASVALLVGLGAMLGRLVETSGGAKSLADTMVRIFGEKRAAFALGVASLIMGFPIFFDAGLVVMLPVIFAVARRLNGSVLTFGIPAAGAFSVMHVFVPPHPGPIAASEFFGAQVGYVLIAGIIVALPTWYLTGYLLGKFLGRKFPLPVPDLLSGGAQEDDQPQNPANAVSIIVILLIPMLLIFGNTGTSMAVSAGLLDAESTMVKILGFLGETPVALLITLIIALFFLGNRRGINGSALEKTIEGALGPICSVVLITGAGGMFGGVLRTSGIGGALADSMADLGLPVIAGCFIVAAVLRVAQGSATVALTTAAALMAPAVAAADFNEFQLAAIVISTAAGSVIASHVNDSGFWLVGRLMNADVPTTLKTWTVNQTCIAIVGFVMAYAMFGLASLA

SEQ ID NO: 631 - DNA, 1608 bp, Corynebacterium glutamicum
  CDS (101)..(1585): RXN00432
agctaatctgccttgctttacacctccgggctataacaatccagtgccagtggctagggatttactaaaaatcgggtaacacgcgcgtagtatttttcgcatggaattattggagaccttcatcactgatgtcattaatgacaatttgtggatgatcttgcccttcttgctcgttgctgctggcctctatttcggtgggcgtacgttgctggttcagattcggatgattccggagatgttcaaagcggtcgtcgagaagcctgcgaaggatggggagttcgcggacaagcaggacatttcggcttttaaggcgttcacgatttctgcggcgtcgcgagttggtacggcgaatgttgcgggtgttgcgctggcgatcactctgggtggaccgggtgcagtgttctggatgtggatcattgcgctggttggcggtgcgacatcgttcattgagtcgactcttggacagttgtggaaggtgaaggacggcgacagctatcgcggtggccctgcgtactacatgacgcttggtttgaatgctcggtggcttgcggttgttttcggtgtcgccatcacgttgacctttggttttgtgtacaacgctttgcagtccaacgcggttgttgaggcgattacggtatcactcggcaccccttctaccactgcaaaggcttttgttggcttgggcatggctggattgtctgcgctggttatttttggcggcgtgcagcgtatcgcaaacgtgacgcagtggatggttccgttcatggcgggtgcgtacatcattgtgggtgtggtggtgattgtgattaacattcagcaggttccgaccatgatcaacgacatcattgctggtgcttttggtttccgtccggttgctactgcgtcggtgtggggcgcgttctggttggcgtttatgaacggtatgcgccgtggactgttctccaatgaggctggtgagggttctgtcccgaacgctgctgctaccgcgactgtgtctcaccctgtgaagcagggtttggttcagactctgggcgtatatttcgacaccctgctcgtttgtagcattaccgcttttgtcatcctgctgtctggagtggagtacgcgaccggcgatattcagtcttcttctttgactcagtccgcgctggctagcgttgttggtggttggggaacccacttcattaccgtagtgatgttcttcctggcgttttcttccgtgctgggtaactactacttggcacaggcgaatattcagtacttcaccgattcgaagactgtcatgactgttttccgactcttggtgctgctcagcgtgttctctggcgcggttgcttcggtgccgttgatctgggctttgggtgatactttcgctggcatcatggtgctcattaacctggcggcgatcattccgctgggtggcgttgcagtgaagttgcttaagaattacaccattcagaagaaggctggtctggatcctgtgttccaccgcgacatgatgccagaggttcgtaatattgcgtgctggaacggcaaagatgcagctacatccaactatcacgaagcgatggaagtgatcaagaagagctagtcatcgaaggaacagtggta

SEQ ID NO: 632 - protein, 495 aa, Corynebacterium glutamicum
MELLETFITDVINDNLWMILPFLLVAAGLYFGGRTLLVQIRMIPEMFKAVVEKPAKDGEFADKQDISAFKAFTISAASRVGTANVAGVALAITLGGPGAVFWMWIIALVGGATSFIESTLGQLWKVKDGDSYRGGPAYYMTLGLNARWLAVVFGVAITLTFGFVYNALQSNAVVEAITVSLGTPSTTAKAFVGLGMAGLSALVIFGGVQRIANVTQWMVPFMAGAYIIVGVVVIVINIQQVPTMINDIIAGAFGFRPVATASVWGAFWLAFMNGMRRGLFSNEAGEGSVPNAAATATVSHPVKQGLVQTLGVYFDTLLVCSITAFVILLSGVEYATGDIQSSSLTQSALASVVGGWGTHFITVVMFFLAFSSVLGNYYLAQANIQYFTDSKTVMTVFRLLVLLSVFSGAVASVPLIWALGDTFAGIMVLINLAAIIPLGGVAVKLLKNYTIQKKAGLDPVFHRDMMPEVRNIACWNGKDAATSNYHEAMEVIKKS

SEQ ID NO: 633 - DNA, 914 bp, Corynebacterium glutamicum
  CDS (1)..(891): FRXA00432
ttgtctgcgctggttatttttggcggcgtgcagcgtatcgcaaacgtgacgcagtggatggttccgttcatggcgggtgcgtacatcattgtgggtgtggtggtgattgtgattaacattcagcaggttccgaccatgatcaacgacatcattgctggtgcttttggtttccgtccggttgctactgcgtcggtgtggggcgcgttctggttggcgtttatgaacggtatgcgccgtggactgttctccaatgaggctggtgagggttctgtcccgaacgctgctgctaccgcgactgtgtctcaccctgtgaagcagggtttggttcagactctgggcgtatatttcgacaccctgctcgtttgtagcattaccgcttttgtcatcctgctgtctggagtggagtacgcgaccggcgatattcagtcttcttctttgactcagtccgcgctggctagcgttgttggtggttggggaacccacttcattaccgtagtgatgttcttcctggcgttttcttccgtgctgggtaactactacttggcacaggcgaatattcagtacttcaccgattcgaagactgtcatgactgttttccgactcttggtgctgctcagcgtgttctctggcgcggttgcttcggtgccgttgatctgggctttgggtgatactttcgctggcatcatggtgctcattaacctggcggcgatcattccgctgggtggcgttgcagtgaagttgcttaagaattacaccattcagaagaaggctggtctggatcctgtgttccaccgcgacatgatgccagaggttcgtaatattgcgtgctggaacggcaaagatgcagctacatccaactatcacgaagcgatggaagtgatcaagaagagctagtcatcgaaggaacagtggta

SEQ ID NO: 634 - protein, 297 aa, Corynebacterium glutamicum
LSALVIFGGVQRIANVTQWMVPFMAGAYIIVGVVVIVINIQQVPTMINDIIAGAFGFRPVATASVWGAFWLAFMNGMRRGLFSNEAGEGSVPNAAATATVSHPVKQGLVQTLGVYFDTLLVCSITAFVILLSGVEYATGDIQSSSLTQSALASVVGGWGTHFITVVMFFLAFSSVLGNYYLAQANIQYFTDSKTVMTVFRLLVLLSVFSGAVASVPLIWALGDTFAGIMVLINLAAIIPLGGVAVKLLKNYTIQKKAGLDPVFHRDMMPEVRNIACWNGKDAATSNYHEAMEVIKKS

SEQ ID NO: 635 - DNA, 569 bp, Corynebacterium glutamicum
  CDS (45)..(569): FRXA00436
gggatttactaaaaatcgggtaacacgcgcgtagtatttttcgcatggaattattggagaccttcatcactgatgtcattaatgacaatttgtggatgatcttgcccttcttgctcgttgctgctggcctctatttcggtgggcgtacgttgctggttcagattcggatgattccggagatgttcaaagcggtcgtcgagaagcctgcgaaggatggggagttcgcggacaagcaggacatttcggcttttaaggcgttcacgatttctgcggcgtcgcgagttggtacggcgaatgttgcgggtgttgcgctggcgatcactctgggtggaccgggtgcagtgttctggatgtggatcattgcgctggttggcggtgcgacatcgttcattgagtcgactcttggacagttgtggaaggtgaaggacggcgacagctatcgcggtggccctgcgtactacatgacgcttggtttgaatgctcggtggcttgcggttgttttcggtgtcgccatcacgttgacctttggttttgtgtacaacgctttgcagtccaacgcggttgttgag

SEQ ID NO: 636 - protein, 175 aa, Corynebacterium glutamicum
MELLETFITDVINDNLWMILPFLLVAAGLYFGGRTLLVQIRMIPEMFKAVVEKPAKDGEFADKQDISAFKAFTISAASRVGTANVAGVALAITLGGPGAVFWMWIIALVGGATSFIESTLGQLWKVKDGDSYRGGPAYYMTLGLNARWLAVVFGVAITLTFGFVYNALQSNAVVE

SEQ ID NO: 637 - DNA, 1572 bp, Corynebacterium glutamicum
  CDS (101)..(1549): RXA00847
tctggcccgctgtgtcctctggacgcagcgggccagtagtattttgggggtgagaataaggtttggaattctaagtgttgtcgcctgcacggtttcgttggtggcatgtcaggctaatccgggtcctgcgcccgttgaggagccaactacagccactgcgacgaccacggcaactgagacgaccaccgtagagactgaagcccccaaacaagatcgggaaaccatcagtattggtatcgatccgatccgcaacggtttcaatccacatttgttgtctgatgattctccactggtgcgcgatactgcatcgttggtgttgccgagtgcttttgagggcaatcagctgaacactgacttgttggacaatgttgagcaggtggatgaaaccacggtgaggtacacgattgctcaggaagcgcagtggagtgatggcactccgattactgggtctgattttgagtacttgcgcaggtccattgtggcggggacaggaacgctgaacgattctgcatattcggcgatttcagagattaggacctcaggcggtggaaaaactgtcgacgttatttttgaacatcctgtcgctgattggcatttgctgtttaacaatttgttgccgagtcatttgatcactggcaattccacattccagacagcgttttatgattccatcccggcctctgcggggcgctacatggtgcgttccattgatcgtcagcgcggcgtgattacgttgtcgcgcaatgatcgtttctggggtgcaaatccggcacacgtggaagtactccaattcaacaccgttgcctctgcatcccgggcgggggagtacctgcgcaccgggcagagttcgtttatgaatctgtcaccgcaggaaaccctggtggacacgttgaatttggtgccggacacggaagtgcgggtgtctgacacgacgcgcacgctggagctggtattcaacgccgaagcgctggcaccggcgcagcgcgcctacctgacatcgcttatcgacgtccccctcaccgccaagttagctggcggtcgcagtgcaaacctgggtgtgccccaaacggtggaggcgagcgtcgataagcaagaaattcctgcgttgcgcctggcggcggaccccgccgacgatgctggtttggcagctgcgcggggcatcgtcgatatgctggctgcggatggaatcaaggctcaggtcgtgacaaccgatttgaattcggcgattgcgggtaattttgatgcgatcgtggcgtggaccagaactgccacggattcgattgcgttggcggaccgagtgggttgtggcgtgaacttggcaaagtggtgcgctgagggaaccacggaatatatcaacggtgttttggcgggtgagattgatttcgatcctgcgtgggagcagcagtttaacaccgagaatcacttgcgggttccgatcctgcgggagactcgggtagaagcgaaaaataacggtatcctcggggctgcggatggctggcctgggggaatttcaagtgctgcaagttggaggaaaaacgatgttgaagaatgatctgtctggtgctcgagttg

SEQ ID NO: 638 - protein, 483 aa, Corynebacterium glutamicum
VACQANPGPAPVEEPTTATATTTATETTTVETEAPKQDRETISIGIDPIRNGFNPHLLSDDSPLVRDTASLVLPSAFEGNQLNTDLLDNVEQVDETTVRYTIAQEAQWSDGTPITGSDFEYLRRSIVAGTGTLNDSAYSAISEIRTSGGGKTVDVIFEHPVADWHLLFNNLLPSHLITGNSTFQTAFYDSIPASAGRYMVRSIDRQRGVITLSRNDRFWGANPAHVEVLQFNTVASASRAGEYLRTGQSSFMNLSPQETLVDTLNLVPDTEVRVSDTTRTLELVFNAEALAPAQRAYLTSLIDVPLTAKLAGGRSANLGVPQTVEASVDKQEIPALRLAADPADDAGLAAARGIVDMLAADGIKAQVVTTDLNSAIAGNFDAIVAWTRTATDSIALADRVGCGVNLAKWCAEGTTEYINGVLAGEIDFDPAWEQQFNTENHLRVPILRETRVEAKNNGILGAADGWPGGISSAASWRKNDVEE

SEQ ID NO: 639 - DNA, 1192 bp, Corynebacterium glutamicum
  CDS (101)..(1192): RXN01382
aaaggatgtacctcatgagcaccacgattactcgccgcaatttcctccgagcaaccggaatcctcggtgtcgcagctggcatcggcgcaacacttgctgcatgtgcaccaacaacaccggcaccagcggatccacctccaccgcagctggcaccggaactgcaaatgaagaaggcaccatcaccgcagccatctcctacgaactgggaaccaacggctacgacccaatgaccaccacctcggctctcactgtggcagccaactggcacacccttgaaggcctcaccgaaatcgacccagccaccggcgaggtctacgcagcactcgccagcgcactgccttcagccgatgcgacctccctagacatcaagcttcgcgacggcgccaccttccacaacggcgacgcagtcaccgcagacgacgtagtcttctcttttgagcgagtcctcgatccagccaacaactccctttacgcatccttcatcccattcatcaagtcagtcaccaagaaggatgacaccaccgtcaccatcgacctcgactacgcaaccggcatcatcagcgaacgcctcgcagtagtaaagatcgtgccaaagtccgtcgtggaagcagacgcatccggattcgacgccaacccaatcggctccggcccatacaagatgaccgacaacggtgcatccaaggtggtcaagttcgagcgcaacgacgactacaacggcccacgcccagcacgtgccgccaagatggaatggcagatcatccccgacgcctccacccgcaccaactcccttcagtccggcagcaccatggccatcgactccgttccatacctgtcgatcccacagcttgaagccaccagcaccgtagaatccgtccaaggattcggcctcctgttcgccatgttcagctgctccgaaggcaaccccttcaacgacgtccgcaaccgccaggcattcctctacgcactggacatggacaagatcgttaagaccggcatgtccgaccaggcaaccccagccacctccttcgtgcagaaggaacaccccaactacaaccaggcatccacggtctactccctcgacgccgacaaagccaaggcgctgttcgctgaaaccggccttaccagcctcaacctcctgtgcaccgaccacgactgggtcaagaactgcaccccactgatccaggaatccctc

SEQ ID NO: 640 - protein, 364 aa, Corynebacterium glutamicum
MCTNNTGTSGSTSTAAGTGTANEEGTITAAISYELGTNGYDPMTTTSALTVAANWHTLEGLTEIDPATGEVYAALASALPSADATSLDIKLRDGATFHNGDAVTADDVVFSFERVLDPANNSLYASFIPFIKSVTKKDDTTVTIDLDYATGIISERLAVVKIVPKSVVEADASGFDANPIGSGPYKMTDNGASKVVKFERNDDYNGPRPARAAKMEWQIIPDASTRTNSLQSGSTMAIDSVPYLSIPQLEATSTVESVQGFGLLFAMFSCSEGNPFNDVRNRQAFLYALDMDKIVKTGMSDQATPATSFVQKEHPNYNQASTVYSLDADKAKALFAETGLTSLNLLCTDHDWVKNCTPLIQESL

SEQ ID NO: 641 - DNA, 1062 bp, Corynebacterium glutamicum
  CDS (1)..(1062): FRXA01382
tccacctccaccgcagctggcaccggaactgcaaatgaagaaggcaccatcaccgcagccatctcctacgaactgggaaccaacggctacgacccaatgaccaccacctcggctctcactgtggcagccaactggcacacccttgaaggcctcaccgaaatcgacccagccaccggcgaggtctacgcagcactcgccagcgcactgccttcagccgatgcgacctccctagacatcaagcttcgcgacggcgccaccttccacaacggcgacgcagtcaccgcagacgacgtagtcttctcttttgagcgagtcctcgatccagccaacaactccctttacgcatccttcatcccattcatcaagtcagtcaccaagaaggatgacaccaccgtcaccatcgacctcgactacgcaaccggcatcatcagcgaacgcctcgcagtagtaaagatcgtgccaaagtccgtcgtggaagcagacgcatccggattcgacgccaacccaatcggctccggcccatacaagatgaccgacaacggtgcatccaaggtggtcaagttcgagcgcaacgacgactacaacggcccacgcccagcacgtgccgccaagatggaatggcagatcatccccgacgcctccacccgcaccaactcccttcagtccggcagcaccatggccatcgactccgttccatacctgtcgatcccacagcttgaagccaccagcaccgtagaatccgtccaaggattcggcctcctgttcgccatgttcagctgctccgaaggcaaccccttcaacgacgtccgcaaccgccaggcattcctctacgcactggacatggacaagatcgttaagaccggcatgtccgaccaggcaaccccagccacctccttcgtgcagaaggaacaccccaactacaaccaggcatccacggtctactccctcgacgccgacaaagccaaggcgctgttcgctgaaaccggccttaccagcctcaacctcctgtgcaccgaccacgactgggtcaagaactgcaccccactgatccaggaatccctc

SEQ ID NO: 642 - protein, 354 aa, Corynebacterium glutamicum
STSTAAGTGTANEEGTITAAISYELGTNGYDPMTTTSALTVAANWHTLEGLTEIDPATGEVYAALASALPSADATSLDIKLRDGATFHNGDAVTADDVVFSFERVLDPANNSLYASFIPFIKSVTKKDDTTVTIDLDYATGIISERLAVVKIVPKSVVEADASGFDANPIGSGPYKMTDNGASKVVKFERNDDYNGPRPARAAKMEWQIIPDASTRTNSLQSGSTMAIDSVPYLSIPQLEATSTVESVQGFGLLFAMFSCSEGNPFNDVRNRQAFLYALDMDKIVKTGMSDQATPATSFVQKEHPNYNQASTVYSLDADKAKALFAETGLTSLNLLCTDHDWVKNCTPLIQESL

SEQ ID NO: 643 - DNA, 335 bp, Corynebacterium glutamicum
  CDS (1)..(312): RXA02659
ttcggcaacgacccagacctcctcatgcgctggtggtacgccggcgacgtctggaccgactcccgcatgcactggaagggcagcgaatcctacgaccaggtacaaaacctcctggaagaaggcatccgcgctaccgacaaggcagaacagcaagacatctggaaccgcaccttcgatgtcatctccgacaatgttcccctctacccgctgttccaccgcaaggtcccaaccgcatggaactccaacgccctcgtcgacttcaagccaatctcactcaccggcttgaacttctcaggtgttgcaactactgaataacaaccccagtggctttcaaa

SEQ ID NO: 644 - protein, 104 aa, Corynebacterium glutamicum
FGNDPDLLMRWWYAGDVWTDSRMHWKGSESYDQVQNLLEEGIRATDKAEQQDIWNRTFDVISDNVPLYPLFHRKVPTAWNSNALVDFKPISLTGLNFSGVATTE

SEQ ID NO: 645 - DNA, 933 bp, Corynebacterium glutamicum
  CDS (101)..(910): RXN02933
tgatctgctgtatcaggtggttgatccaagagtcggtgctgttggggttgctagcactaaggttccagggagcgtggcttaagtgacaacgatcaaaaacatgcccctttcagggaaaatcggcggcttcatcgttgccgttgtatttgttcttgctgcgctgtctttcatttggactccgtttgatccagttcaagctttcccacaggagcgccttgagggaagttctttgaggcacctgttgggaacggatcgttatggtcgcgatgttttatcccagatcatggttggttcccgcgtcacgttgttggtgggcatcattgcggtggcgatcgcagcattaatcggcacgccactgggtattgctgcgggaatgcgccgtggcatggtggaaacctttgtcatgcgtggtgccgatttaatgttggcgttcccagcactgttgttggcgattatttccggcgccgttttcggcgcctccacgtggtccgcgatggtcgcgatcggcatcgcaggcatccctagttttgcccgcgtggctcgtgcaggcacattgcaggtgaccagtcaggatttcatcgcagctgctcggctatcaaaagtaagttccgcccggatcgcgcttcgccatattttgcccaacatcaccagcatgttgatcgttcaggcatcagtagcttttgccctggcgatcctggcggaagccgcattgagtttcctcggtttgggcaccactcccccggatcccagctggggtcgcatgttgcaaaccgctcaagcatccatcggcgtcacccccatgttggcggtgtggcccggtgctgcgatcgctttgacggtccttggttttaatcttttcggtgatggtttacgcgatgccatcgatccaaagcgggaggtcggccgtgcttaaagtttctgatttaacggttg

SEQ ID NO: 646 - protein, 270 aa, Corynebacterium glutamicum
MPLSGKIGGFIVAVVFVLAALSFIWTPFDPVQAFPQERLEGSSLRHLLGTDRYGRDVLSQIMVGSRVTLLVGIIAVAIAALIGTPLGIAAGMRRGMVETFVMRGADLMLAFPALLLAIISGAVFGASTWSAMVAIGIAGIPSFARVARAGTLQVTSQDFIAAARLSKVSSARIALRHILPNITSMLIVQASVAFALAILAEAALSFLGLGTTPPDPSWGRMLQTAQASIGVTPMLAVWPGAAIALTVLGFNLFGDGLRDAIDPKREVGRA

SEQ ID NO: 647 - DNA, 715 bp, Corynebacterium glutamicum
  CDS (101)..(715): RXN02991
ttgtcgtgttcgcgatcttcgccgttggcttcatgattctgaccctgcctatgggccttggcttgggcaaactctctgagcgtttggcggtgaagaagtaatggctaatacagttcgcgcaacagtcctctacgatgctcctggaccaaagggccgtcgattcaacctcataatcaccattctcacggtggttctgggattggcgctcctcttctggattggctccatgctttcaggcaacggccaactcgatgccaacaaatggactccgttcatcaattcccaaacctggaccacctacattcttcctggtttgtggggcacgctgaaatctgccgtgttctcggtgatcttggctctggtcatgggtaccgcactgggtcttggccgtatctctgaaatcaggattctccgctggttctgcgccgtcatcatcgagactttccgagccattccggttctgatcctcatgattttcgcctaccagatgttcgcccagtacaacatcgtgccgtcgagccagctcgcgttcgccgccgtggtattcggtctgaccatgtacaacggttctgtgatcgcagagattctgcgttctggtatcgcttccctgcctaaggggcagaaggaagcagcgattgcgttgggtatgtcttctaggcaaaccacctggtcaatcttgttgcctcaggccgtggctgcaatgctcccagcgttg

SEQ ID NO: 648 - protein, 205 aa, Corynebacterium glutamicum
MANTVRATVLYDAPGPKGRRFNLIITILTVVLGLALLFWIGSMLSGNGQLDANKWTPFINSQTWTTYILPGLWGTLKSAVFSVILALVMGTALGLGRISEIRILRWFCAVIIETFRAIPVLILMIFAYQMFAQYNIVPSSQLAFAAVVFGLTMYNGSVIAEILRSGIASLPKGQKEAAIALGMSSRQTTWSILLPQAVAAMLPAL

SEQ ID NO: 649 - DNA, 245 bp, Corynebacterium glutamicum
  CDS (1)..(222): RXN02992
atcgtccctttgggcaacacactgatcgcactgactaagaacaccaccatcgcctctgtcattggagttggcgaagcctccctgctgatgaaagccaccatcgaaaatcacgccaacatgctatttgtcgtgttcgcgatcttcgccgttggcttcatgattctgaccctgcctatgggccttggcttgggcaaactctctgagcgtttggcggtgaagaagtaatggctaatacagttcgcgca

SEQ ID NO: 650 - protein, 74 aa, Corynebacterium glutamicum
IVPLGNTLIALTKNTTIASVIGVGEASLLMKATIENHANMLFVVFAIFAVGFMILTLPMGLGLGKLSERLAVKK

SEQ ID NO: 651 - DNA, 792 bp, Corynebacterium glutamicum
  CDS (101)..(769): RXN02996
tcctgccacagaatctgcctgctgctccattaactaaaaattgcaggctagaatagagggtcgattaggagtcgatgaaaaagtcggcgccaacgaggagatgaacaacaacgtgagtgatcaaaagctaagtggtaaagagcttgcggcactagagaaacaagccgcaaaaactctcgaacttggtgataagaagtggtatctcatcgcgggagtcgtgcttttcgccatcgcactcgtcctcccacatatccgtggagtgatgggctggcaggttctgacgctgtcgaatgtcgcggaggatgccggcattacccttggtgagtacggtttctactggttgggcaccatcggtgtattcctgctttctttgggcactgtcgtgtttaagcgcacgtggatggcgtggatttcatggattttctcctgcgtcactcttgtgttcgctgtgtttgccatctggatgcgccaaacaaccaccagcacccaagtgaatttcgtcaacattggcatgatgcttgctgtgattgcagcgatccttgctgtgtggggtctatcttcggtgattttggcccgcagtgatcgccaaatggagatcgctgaaatgcgcgccgagaacccagaccttgatggtgttgcagctacccagcgcgcacttcttgagcagcagcaaagcaacccagaagataatcctttgcttgtcgacgatcgtcgcgcccgcatcgcccgccgccgcgagcgtgaacaggatgcacaaggggagcaggcttaagttctagttcaagcggttga

SEQ ID NO: 652 - protein, 223 aa, Corynebacterium glutamicum
MNNNVSDQKLSGKELAALEKQAAKTLELGDKKWYLIAGVVLFAIALVLPHIRGVMGWQVLTLSNVAEDAGITLGEYGFYWLGTIGVFLLSLGTVVFKRTWMAWISWIFSCVTLVFAVFAIWMRQTTTSTQVNFVNIGMMLAVIAAILAVWGLSSVILARSDRQMEIAEMRAENPDLDGVAATQRALLEQQQSNPEDNPLLVDDRRARIARRREREQDAQGEQA

SEQ ID NO: 653 - DNA, 1017 bp, Corynebacterium glutamicum
  CDS (101)..(994): RXN03126
tcttggacaacattaccccacacacgggacactcaaacgtgcatgaattcacctgtcgtcgatacccaaaaatcactccaccaccactagggtgtcttatgtgcaggaacaatcgaagcagaaagacctccaggctgatatcgccagaatcactgccgtgaaatcggacacagttccgaattcccagtcaatgacctttggcgctgcctggaacgatatcgtccgcggattcaagcaacatgagttgtggctgcaactcggctggcaagacattaagcaacgctaccggcgatccgtccttgggcccctgtggatcaccatcgccaccggtgtcatggcgctcgccctcggcttgctgtactccgtgctgttcaaaatccccatcgcggaatttctgccccacgtcaccgtcggcctgatcatttggaacttcatctccggatgcatcaaagaaggctccgacatcttcatagataacgagggactcatcaaacagctcccctcggcgctgtccgtccacgtgtacagactcgtgtggaaacaagccctcttcctcgcccacaacctggtcatctgggtcattctcatgatgatcttcccccgacccctcggctgggacgtcctcctgatcatccccgcaatgttcctcctggtgatcaacggcgtgtgggtagtcatgttcttcggcatcatcgccacccgctaccgcgacgtctccccgttgctagaagccggaacccaactcctcttctacgtcacccccatcgtctggatgacttccaccctgcaatcccagagcgcagaaatcggcaaccgcgcacgcctcgccgaactcaacccgctctaccactacctcgaaattgtccgcgcccccatggtcggcgccgacctccccgcctaccactggtggatcgtcctcgccttcacattcgtcggccttggccttgctctcctcgcgatgaagcaatggcgattccgcgtcagctactgggtataaggagcaccacatggtatcca

SEQ ID NO: 654 - protein, 298 aa, Corynebacterium glutamicum
VQEQSKQKDLQADIARITAVKSDTVPNSQSMTFGAAWNDIVRGFKQHELWLQLGWQDIKQRYRRSVLGPLWITIATGVMALALGLLYSVLFKIPIAEFLPHVTVGLIIWNFISGCIKEGSDIFIDNEGLIKQLPSALSVHVYRLVWKQALFLAHNLVIWVILMMIFPRPLGWDVLLIIPAMFLLVINGVWVVMFFGIIATRYRDVSPLLEAGTQLLFYVTPIVWMTSTLQSQSAEIGNRARLAELNPLYHYLEIVRAPMVGADLPAYHWWIVLAFTFVGLGLALLAMKQWRFRVSYWV

SEQ ID NO: 655 - DNA, 927 bp, Corynebacterium glutamicum
  CDS (101)..(904): RXN00443
taaacaaggagcgtttaatttccacccaatcccactgaaagtttcccaccccacagttatgctgattaagtactgaacttaccgtaggaaaggcactcaggtgaacaaaagtatccgtcgagctctctacagtttcatcactatttcggcgggtatctcactcgtagcgtgctcttcttcagacaccgcaagcactaccacccagaatgcctctgctaccgaagcagctggggtttccggaaccgctagcgttttcgctgcggcgtctttgaccaacgttgctgaggatctcgcggctgcgttcaacgaagacaatcctgatgcaaagttggagtttaacttcgctggttcttccgcgctggttcgccagatcagcgaaggcgcaccatctgatctgttcatttctgcggacatcgccaacatggacgatgcgctggcacttccagaatttgccggcgcaacctcgaaggtcatcgctaccaacaagctggtgctggtcaccgcagacggcaaccccggcgaaatttcagagcttgccgacgtcaaggactccctcgttgctatctgcgcccctgaagttccatgtggaaccatcacccacgaggctttggactacgcagacatcgagttgaacaccagctctgaggaagccaatgttgctgatgtcgccacgaagatttccaccggtgcagttgatgcgggctttgtttaccaaaccgacgctcagtctttggctaaaactcaggacaacactgtcattgaactcgaaggtatcgacgccaacgaatacccaatggcattgaccaccaccggtgaagacaacgaggtagcgaaggctttcgcagagttcctcagcagcgatcgtgccaaggagatccttgccagctatggttttggcacaaactaaaaaggctcgtcgaagcgaga

SEQ ID NO: 656 - protein, 268 aa, Corynebacterium glutamicum
VNKSIRRALYSFITISAGISLVACSSSDTASTTTQNASATEAAGVSGTASVFAAASLTNVAEDLAAAFNEDNPDAKLEFNFAGSSALVRQISEGAPSDLFISADIANMDDALALPEFAGATSKVIATNKLVLVTADGNPGEISELADVKDSLVAICAPEVPCGTITHEALDYADIELNTSSEEANVADVATKISTGAVDAGFVYQTDAQSLAKTQDNTVIELEGIDANEYPMALTTTGEDNEVAKAFAEFLSSDRAKEILASYGFGTN

SEQ ID NO: 657 - DNA, 960 bp, Corynebacterium glutamicum
  CDS (101)..(937): RXN00444
tacccaatggcattgaccaccaccggtgaagacaacgaggtagcgaaggctttcgcagagttcctcagcagcgatcgtgccaaggagatccttgccagctatggttttggcacaaactaaaaaggctcgtcgaagcgagaatcatatcctcccagggtggttgctcatcccagccaccctggccatgctgctgatcattggacctatttttgctttgctgttgcagatcccctgggatcggtcttgggagttgcttaccgcgccggaatctttaggaaccgcacggttatctatcggaactgctctgttttctaccgcgctatgcgcaattgtgggtttcccgctagcgttggcgctgcatttatatgagcgttcgcaccccagggtgacatcagttttgacggtgctggtttatgcgcctttggtgttgtcgccggtggtgtctggtttggcgctgacttttctgtggggcaggcgtggttttttaggttcttggcttgatcaggttggattgccgattgcatttaccaccacggctgtggtgtttgcccaggtgtttgtagcgttgccatttttcatttccactgtgactactgcactgcgtggcattccaaaacagtttgaggaaatcgcagctactgaaggcgcaacccgctgggagatcatgcacaagatgatcattccgctggcgatgcctggaattttcaccggtatgattttgggattcgccagggccttgggcgagtatggtgcgacactgacttttgctggaaatattgcaggtgttacccgcaccattccgttgcatattgagcttggtttgagttccaatgacatggataaagccttgggagcggtgattatgcttttggctgtctatgtcctcatcattggagccatcggagcgttacgattgttttccaaggtgagaaaggtttaattgatgtctcgttcgccgga

SEQ ID NO: 658 - protein, 279 aa, Corynebacterium glutamicum
MVLAQTKKARRSENHILPGWLLIPATLAMLLIIGPIFALLLQIPWDRSWELLTAPESLGTARLSIGTALFSTALCAIVGFPLALALHLYERSHPRVTSVLTVLVYAPLVLSPVVSGLALTFLWGRRGFLGSWLDQVGLPIAFTTTAVVFAQVFVALPFFISTVTTALRGIPKQFEEIAATEGATRWEIMHKMIIPLAMPGIFTGMILGFARALGEYGATLTFAGNIAGVTRTIPLHIELGLSSNDMDKALGAVIMLLAVYVLIIGAIGALRLFSKVRKV

SEQ ID NO: 659 - DNA, 594 bp, Corynebacterium glutamicum
  CDS (1)..(594): RXN00193
  unsure 11: n indicates any nucleotide
  unsure 4: Xaa indicates any amino acid
aaagctttctnccaacgcgaaggtttcatctcagccttcggtttcaccgtcctcgtggtcatcgtctccgtgatcacagtcaacatcttcgccttcctcttggcgtggttgctgacccgcaaactccgcggtaccaactttttccgcacagtcttctttatgccgaaccttatcggcggcattgtgctgggttatacctggcagaccatgatcaacgccgtgctttcgcactatgccacgactattagcgcggactggaaattcggctacgccggcctcatcatgctacttaactggcagctcatcggctacatgatgatcatttacatcgccggcctgcaaaacgtcccaccagagctcattgaggctgccgaactcgacggcgtcaacaagtgggagatgctgcggcacgtcactattccgatggtcatgccatccatcaccatctgcctctttttgactttgtcgaactcctttaagctcttcgaccagaacctggcgctgaccaacggcgctcctggcgggcaaactgagatggtggcgctcaacatcatcaacacgctgtttaaccgtatgaatgtcgagggcgtcggt

SEQ ID NO: 660 - protein, 198 aa, Corynebacterium glutamicum
  unsure 4: Xaa indicates any amino acid
KAFXQREGFISAFGFTVLVVIVSVITVNIFAFLLAWLLTRKLRGTNFFRTVFFMPNLIGGIVLGYTWQTMINAVLSHYATTISADWKFGYAGLIMLLNWQLIGYMMIIYIAGLQNVPPELIEAAELDGVNKWEMLRHVTIPMVMPSITICLFLTLSNSFKLFDQNLALTNGAPGGQTEMVALNIINTLFNRMNVEGVG

SEQ ID NO: 661 - DNA, 1053 bp, Corynebacterium glutamicum
  CDS (101)..(1030): RXN01298
cttaaacgtcaccttatttatgcattatgttggtttcagactcgaacaattcaattagaaaacactaatcggacatttaggtcacataacatttccgctcgtgtccacattaatttctgaacccgaggtggataagctacgtaaacgtgccaagagatcaaggcggacagaatggtggcttgccgccgcacttcttgccccaaacttgcttctcttggccatctttacgtatcggccactgttagataacttccggttgtcctttttcaactggaacatttcctcgcccacatcaaccttcattgggtttgataactacgttgagttcttcactcgtagtgacactctccaagttgttttaaacaccgtcatcttcacggcatgtgctgtgatcggatcgatggtgctcggtttgctcctggccatgttgttggatcagaagcttttcggccgtaactttgtgcgttccatggtgtttgccccgtttgtgatttccggtgctgccattggtgttgctttccagttcgtttttgaccctaattttggtttggttcaggacttgctgggacgcatcggcgttgattcgccacagttctaccaaaaccctaactgggcattgttcatggtgacgttcactttcgtgtggaagaacttgggctactcctttgttatctacctggctgcattgcaggggctaaacaaggatttgtctgaggccgcaccggtggatggcgcgagcgcgtggacacgtttttggaaggttactcttccgcagcttcgcccaaccacgttcttcctttctattactgtcacgctgaactcggttcaggtcttcgacatcattcacaccatgactcgtggtggccccttgggtaacggtacgaccaccttggtttaccaggtgtacaccgagactttcaccaactatcgcgcgggatatggtgcaacaatcgcaacgattttgttcctgttgctgctgattatcactgttatccaggttcgatacatggataaggagaacaagcagaaatgatctcgactgatagaaacgtt

SEQ ID NO: 662 - protein, 310 aa, Corynebacterium glutamicum
VSTLISEPEVDKLRKRAKRSRRTEWWLAAALLAPNLLLLAIFTYRPLLDNFRLSFFNWNISSPTSTFIGFDNYVEFFTRSDTLQVVLNTVIFTACAVIGSMVLGLLLAMLLDQKLFGRNFVRSMVFAPFVISGAAIGVAFQFVFDPNFGLVQDLLGRIGVDSPQFYQNPNWALFMVTFTFVWKNLGYSFVIYLAALQGLNKDLSEAAPVDGASAWTRFWKVTLPQLRPTTFFLSITVTLNSVQVFDIIHTMTRGGPLGNGTTTLVYQVYTETFTNYRAGYGATIATILFLLLLIITVIQVRYMDKENKQK

SEQ ID NO: 663 - DNA, 1182 bp, Corynebacterium glutamicum
  CDS (101)..(1159): RXA01737
ctttgagccgaacgatctgccgactcaagaagaactagcccggctgctcagtcaggaatgatgcgcctaagatcaaacaagaatgaaaggacggtgaacaatgggccgaatgaaaaacgatggtgaactcgcggatctgccggatcatgcacttttgagcattattcgaatcccgcaggcggcgaaaagaagcccctgggcgctgatcttaacgcgcatcggatacgcgatggtgctgctggttatcgtcaccatggttgtctattttgaccgcaacggatactccgaagacctcacgttcatcgacgcgttgtactattccacagtctcgttgaccaccgtgggctacggcgatatcaccccggtgacgcaatcggcacgcctgatcaacatcatcgtcctcaccccagcacgcatcggcttcctgatcctcctggtcggcaccaccttgtcagtgctcaccgaagaatcgcgccgggccctgcaaatccaacgttggagaaaacgcatgcgcaaccacaccgtcgttgtcggatacggaaccaaaggtcgctccgcggtcgctgcactgcttggcgacggcgtccccgccaaccagatcgttgttatcgacaccgatcaagtctccctcgacgccgccaacaacagcggactcgtcaccgtcaaaggctccgccaccaaagcagatgtgttgcgtctagctggcgtgtcacgagcgcgcgccgtcgtcgtggcaccgaacctggacgatactgcagttctggtgactctatcggtgcgagaaatcgcgccgcaggcaatgattgtggccagtgtccgagaatctgaaaaccaacacctcctcgaacaatccggtgcggactcggttgtgatctcctcagaaaccgctggccgaatgctcggtctggcaacagttaccccatcggttgtggagatgatggaagacctcctctcacccgacgaaggattctccgttgccgaacgactagtcggtgaggatgaaatcggctccaacccacgacacctcgctgacatcgtcctcggtgttgttcgatccggtgagctctaccgcatcgactccccagaagcagaaactgtagagcccggcgatcgtctcctttacgttcgccgagtatttagcgaggaggtaaatgacaaatgagaattcttcccatcggcccc

SEQ ID NO: 664 - protein, 353 aa, Corynebacterium glutamicum
MGRMKNDGELADLPDHALLSIIRIPQAAKRSPWALILTRIGYAMVLLVIVTMVVYFDRNGYSEDLTFIDALYYSTVSLTTVGYGDITPVTQSARLINIIVLTPARIGFLILLVGTTLSVLTEESRRALQIQRWRKRMRNHTVVVGYGTKGRSAVAALLGDGVPANQIVVIDTDQVSLDAANNSGLVTVKGSATKADVLRLAGVSRARAVVVAPNLDDTAVLVTLSVREIAPQAMIVASVRESENQHLLEQSGADSVVISSETAGRMLGLATVTPSVVEMMEDLLSPDEGFSVAERLVGEDEIGSNPRHLADIVLGVVRSGELYRIDSPEAETVEPGDRLLYVRRVFSEEVNDK

SEQ ID NO: 665 - DNA, 2007 bp, Corynebacterium glutamicum; identical to SEQ ID NO: 549
  CDS (101)..(1984): RXN02348

SEQ ID NO: 666 - protein, 628 aa, Corynebacterium glutamicum; identical to SEQ ID NO: 550

SEQ ID NO: 667 - DNA, 1656 bp, Corynebacterium glutamicum
  CDS (101)..(1633): RXA02426
tgcagcagcataatcagggaaaaataggaactgtttactgaaaaactgacaaacctgacagacctgacccgaagagaccttattcatgacgatattgttcatgctcattacattgctgctcgccaccgtgattgtggtggccatcggcgataaaaccggactcccctggcctgctttgatgactattgtcgccgcaggtggagcgttgttgccatttttgccggaatttactatcccggccgatctgatgttgcctattttcattccgccgctgctgtgggcgctggcgaggaagtcatcgtgggcggtgattaggtcgcagatgtctaccatcatcacgatgtcggtgttgttggtgttcgtgaccatcgcggcactcacgggtgcatccatgctgttgcttcctggcattggtcttgctggtgcgatcatgttggctgcggctattgctccaccggatcctgttgctgttgatgcagtggcggaacctgcgggaatcccgaagcgcatcaccaccactttgcagacggagggtctgtttaatgatgcagccagcatcgtggcgttccatgtggctttagctgccctggtcgctggtgaggatttgtcctggtcaacgggtgttttggaattcttgtggtcgtgtcttgctgccgttattttgggcttggttattggccgggcggctgcgtggtttaccgatcacgtgagttccgttgaggctcgaaatgcgtttacgtgggtgctgccgtttgccatttatgtggtggcggaagaaatcggcggatcgggcgttatcgccattgtgatcgctgcagtggagatgaattcgagggcgtcgattggtgcggaggatcgtctaacgggttctgcgttctggggaaccattgaggtgctgtttactggcgttgcctttggtttgatcggcctgaatgtgcgcgctgcgattgatgaagttggatctgagctgtggcatgccgtggtcgtgggcattgtgctctcggtggtggcgatcgttgtccgtggtgtgtggatgttcgcggcgtataagcgcaatcgtttcaagatcgataagaagggtgcgaccaatagttcattgcgggcgcctcttcgactgcaggaatcgttgctgatgacgtgggcgggcatgcgcggtttggtgacgttggcgctggtgctgtctattccggaggatattttcccgtatcaccacgagttgcaggtcattgcgctggtcgttctcttaatcaccatggtgggccctggtttgacgttgccgtggctgatgcggaagctcagcttggataagggtcccgatgctgcgggcgatgagagtatcgccgcgctgacagagagggctcacaaggccgcaacaacgtatttggtggataccacggagttgccgatggagcagatggtggcgatcaagaattggttctcgcaagaaattgacgctgatgaactgcaggagaacgtcgataagctgcatcagcgcgcgcatcatgcgcgtgtcggggcaattaaggcggcccaggaggagctgttgaaggcgcggcgggagcgcggcgttaatccggcctatgttgatgaggtgttgaccaacattgaccggatgcttgttgcggctgaacgctagataaacagcagcaggctgat

SEQ ID NO: 668 - protein, 511 aa, Corynebacterium glutamicum
MLITLLLATVIVVAIGDKTGLPWPALMTIVAAGGALLPFLPEFTIPADLMLPIFIPPLLWALARKSSWAVIRSQMSTIITMSVLLVFVTIAALTGASMLLLPGIGLAGAIMLAAAIAPPDPVAVDAVAEPAGIPKRITTTLQTEGLFNDAASIVAFHVALAALVAGEDLSWSTGVLEFLWSCLAAVILGLVIGRAAAWFTDHVSSVEARNAFTWVLPFAIYVVAEEIGGSGVIAIVIAAVEMNSRASIGAEDRLTGSAFWGTIEVLFTGVAFGLIGLNVRAAIDEVGSELWHAVVVGIVLSVVAIVVRGVWMFAAYKRNRFKIDKKGATNSSLRAPLRLQESLLMTWAGMRGLVTLALVLSIPEDIFPYHHELQVIALVVLLITMVGPGLTLPWLMRKLSLDKGPDAAGDESIAALTERAHKAATTYLVDTTELPMEQMVAIKNWFSQEIDADELQENVDKLHQRAHHARVGAIKAAQEELLKARRERGVNPAYVDEVLTNIDRMLVAAER

SEQ ID NO: 669 - DNA, 993 bp, Corynebacterium glutamicum
  CDS (101)..(970): RXN03164
cttttttgcatccagatgcacaaagccgtggcacaaacgagacaaactgagcacaatggctgtcatggcatatcaaccagcagacaatcgctatgacgacatgatctaccgcagggtgggaaattctgggctgaagcttccggcaatttcgcttgggctgtggcacaacttcggtgatgacaagccgctttcaacgcagcgcagcattattcaccgcgcgtttgataggggagtcactcacttcgatttggctaataactatggacctccagcaggttccgcagagaccaactttggcaggattttgcgtgaggatctcaaaagccaccgcgatgagttgatcatttcttccaaggcgggttgggatatgtggcctggaccttatggttttggtggttcccgaaagtatctagtgagttcccttgatcagtccctgactcgcctcggcttggattacgtggatattttctatcatcaccgcccggatccagatactcctttggaagaaaccatgtacgcattgcgtgacattgttgcgtctggaaaggctctttacgtgggtatttcttcctacggtccagagctcacagcggaggcggctgagttcatggcggaggagggctgcccgcttctgattcatcagccaagctattccatcattaatcgttgggtggaggaaccgggcgatgacggtgagaacttgttgcagtcagctgccaacaatggtcttggcgtcattgctttctcaccacttgcgcagggcctgctcacggacaaatatctcgatggaattccagagggttcccgcgccagccagggtaagtccctgtctgagggcatgttgaacgtgaacaatattgatatggtccgcaagctcaatgacatcgcccaggaacgcgggcagtcacttgcgcagatggcgcttgcatgggtgctgcgcgagcaaagagagtacggcgccggattaccgtgaccagtgcattgattggtgct

SEQ ID NO: 670 - protein, 290 aa, Corynebacterium glutamicum
MIYRRVGNSGLKLPAISLGLWHNFGDDKPLSTQRSIIHRAFDRGVTHFDLANNYGPPAGSAETNFGRILREDLKSHRDELIISSKAGWDMWPGPYGFGGSRKYLVSSLDQSLTRLGLDYVDIFYHHRPDPDTPLEETMYALRDIVASGKALYVGISSYGPELTAEAAEFMAEEGCPLLIHQPSYSIINRWVEEPGDDGENLLQSAANNGLGVIAFSPLAQGLLTDKYLDGIPEGSRASQGKSLSEGMLNVNNIDMVRKLNDIAQERGQSLAQMALAWVLREQREYGAGLP

SEQ ID NO: 671 - DNA, 1068 bp, Corynebacterium glutamicum
  CDS (101)..(1045): RXN00024
ttaagacatcaacatatggcttgtgctactgaaagatttttcttctgaaattctgtagaaacgctcctatgctcggggcagtaagttgtgagcataggaaatggagcacggcgtgaccgttattaaaggcactgaatttgatgttttcccactaaacctcggtggaaatacctttggctggacctcgaatagggaacagaccttcgcggttttggatgcattcgtggcagcgggaggaaactttgttgacaccgccgattcttattctgcatgggttgaaggcaatgagggtggcgagtcggagcgggagctcggcgcgtggattaaggaacgtggcgcagacaagctgatcattgctaccaagtctggtgcgttggagcctgttgctggtcgttcccgtgaggcaactttcaaggctgtcgagggttccctggagcgtttgggcgtggaatcgatcgatattttttactaccactacgacgatgaggcagtcagcattgatgagcaggttgctatcgctaatgatctgattgcacagggcaagattaagcacctcgcattgtctaactacagcgcggagcgtttagctgagttctttgagaagtctgtaggcactccagcgcagccggttgctctgcaaccgcactacaacctggtgtcgaggaaggattatgaggagaacgtgcagccactcgccgagaagcatggcgttgcagtcttcccttatttcgcgcttgccgcgggtcttttgaccggaaagtacacctccaaggaggatatttcgggtaaagcgcgtgcggggcagttggatcgttacgccagcgatgaggcgtttgccgtggtgacagagttgcgtgctgttgccgatgagttgggtgttgcgccaacgactgtggcgcttgcgtggttggttgcgcatggtgtgaccgcaccgattgcgtccgtgtccaaggtagagcagttgaaggatttgatggctgtgaaggatgtggagctgagcgctgagcagcttgcacgtttggataaggtttcggagcctttcgcttaagctctcctcaaaagtaagtg

SEQ ID NO: 672 - protein, 315 aa, Corynebacterium glutamicum
MEHGVTVIKGTEFDVFPLNLGGNTFGWTSNREQTFAVLDAFVAAGGNFVDTADSYSAWVEGNEGGESERELGAWIKERGADKLIIATKSGALEPVAGRSREATFKAVEGSLERLGVESIDIFYYHYDDEAVSIDEQVAIANDLIAQGKIKHLALSNYSAERLAEFFEKSVGTPAQPVALQPHYNLVSRKDYEENVQPLAEKHGVAVFPYFALAAGLLTGKYTSKEDISGKARAGQLDRYASDEAFAVVTELRAVADELGVAPTTVALAWLVAHGVTAPIASVSKVEQLKDLMAVKDVELSAEQLARLDKVSEPFA

SEQ ID NO: 673 - DNA, 1758 bp, Corynebacterium glutamicum
  CDS (101)..(1735): RXN01164
gccgatcgtgattgatgaagacgagatccaagcctggacttctgatctcaaacctgaagatttcaccaaaggtaaagatgaatccgacggtgagaaataagtgacactgtttgttcggctcgcccttgctgctgtgggcgggctttttgtctttgcttccaatgaaccgatcggctggtttgtcgcgggaattgttggcactgcattattttttatctcccttgcgccgtgggatctgggagttccccaaaagcggcggaagaagaatgagccagtcccatttttgcaacagatgtccacgggcccaactgttgtacagggcatgcttttaggttttgtccatggcctggtgacatatttgcagctgttgccgtggatcggtgagtttgttggctcactgccttatgtcgcgttgtcagttgtcgaggcgctttattccattgctcttggtgctttcggcgtgctcattgcgcgttggagggactggaaggttctcctgtttccggcgatgtatgtggctgtggagtatctaagaagctcgtggccatttgatggattcgcgtgggttcgcctggcatggggtcaaattaacggtccgttggctaatctcgcagcgcttggtggggtagcgtttgtcactttttccacggtgctggctgccgtgggtgtggccatggtgattatttccaagaagcgactggccggcgcaatcatcaccgcgagtgtgattgctatcggcgcggtgtcatccctgtacgttgaccgcaatggcacgagcgatgaaagcatcgaagtagccgcaattcagggcaatgtgcctcggatgggattggacttcaatgcacagcgccgcgcggtgctggcgaatcacgcacgggaaaccctcaagctggatgaacaagtggatttggtgatctggccggagaattcctcagacgtcaacccattttccgatgcacaagcaagagccattatcgatggagcagtggaacatgttcaggcacctattttggtgggcacgatcaccgtcgatgaggttggtccacgcaacaccatgcaggtatttgatcctgttgaaggtgccgcggagtaccacaataagaagttcttgcagccgtttggtgaatacatgccgtttcgcgaattcctgagaattttctcgccctacgttgattccgctggaaacttccagcccggtgatggcaccggcgtagtggagatgaatgctgcgaacttaggccgcgctgtgacagtgggcgtgatgacgtgttacgaggtcatcttcgaccgtgctggccgcgacgccatcgccaatggggctgaatttttgaccacgcccaccaacaacgccaccttcggattcacggacatgacgtatcagcaattagcaatgagcaggatgcgtgccatcgaatttgatagggcggtggttgttgcagctacatcgggtgtttcggctatcgtcaaccctgatggaagcatttcccaaaacacccgaatttttgaggccgccaccttgacggaatccattccactcaaggacactgtcaccatcgcagcgcgggttggtttctatgttgaattactgttggttatcattggtgtattagctggactattcgccattcgaatgaatagccgttcaaagtctgcgaaaggttccgctcggcccgcacaagttcgggttaagaaggtgcctgcgaaaaaggcagcaactaatcgtcgaaaagtaaaataaaaacgtcccgaagggacgag

SEQ ID NO: 674 - protein, 545 aa, Corynebacterium glutamicum
VTLFVRLALAAVGGLFVFASNEPIGWFVAGIVGTALFFISLAPWDLGVPQKRRKKNEPVPFLQQMSTGPTVVQGMLLGFVHGLVTYLQLLPWIGEFVGSLPYVALSVVEALYSIALGAFGVLIARWRDWKVLLFPAMYVAVEYLRSSWPFDGFAWVRLAWGQINGPLANLAALGGVAFVTFSTVLAAVGVAMVIISKKRLAGAIITASVIAIGAVSSLYVDRNGTSDESIEVAAIQGNVPRMGLDFNAQRRAVLANHARETLKLDEQVDLVIWPENSSDVNPFSDAQARAIIDGAVEHVQAPILVGTITVDEVGPRNTMQVFDPVEGAAEYHNKKFLQPFGEYMPFREFLRIFSPYVDSAGNFQPGDGTGVVEMNAANLGRAVTVGVMTCYEVIFDRAGRDAIANGAEFLTTPTNNATFGFTDMTYQQLAMSRMRAIEFDRAVVVAATSGVSAIVNPDGSISQNTRIFEAATLTESIPLKDTVTIAARVGFYVELLLVIIGVLAGLFAIRMNSRSKSAKGSARPAQVRVKKVPAKKAATNRRKVK

SEQ ID NO: 675 - DNA, 933 bp, Corynebacterium glutamicum
  CDS (101)..(910): RXN01168
ccgcacaagttcgggttaagaaggtgcctgcgaaaaaggcagcaactaatcgtcgaaaagtaaaataaaaacgtcccgaagggacgaggaggacaacaccatgagcagtgaggcagtagatgctacgacgctggtgattattccaacgtacaacgagctggaaaaccttccactcatcgtggatcgcgtgcgcaccgcaacccctgacgttcacgtactcatcgtggacgacaacagcccagacggcaccggcgagcgcgcagacaagcttgctgctgacgacgaccacatttttgtcctccaccgcgaaggcaaaggcggcctgtgcgcagagtacatggctggcttccagtggggcctggagcgcgactaccaggtcctgtgcgaaatggacgccgacggctcccacgcaccagaacagctgcacctgctgctcgctgagatcaccaatggcgctgacctggtcatcggctcgcgctacgtgccaggcggccgcgtagtcaactggcccaagaaccgttggctcttgtccaagggcggcaacgtctacatcagcgtcgcgctcggcgccggcttgaccgatatgaccgcagggtaccgcgcttttcgacgtgaagtgctagaagcactgccgcttgatgagctctccaacgctgggtacattttccaagttgagattgcctaccgtgcagttgaagccggattcgatgttcgtgaagttcccatcactttcaccgagcgtgagatcggcgaatccaagctggacggcagctttgtcaaggattccctgctcgaggtaaccaagtggggcctcaagcaccgcggtggccaggccaaggaactgtccaaggaaatggtcggcctgctgaactatgagtggaagcacttcaaaaagcgcaacacctggctctaaactgcttgccggttagtgaa

SEQ ID NO: 676 - protein, 270 aa, Corynebacterium glutamicum
MSSEAVDATTLVIIPTYNELENLPLIVDRVRTATPDVHVLIVDDNSPDGTGERADKLAADDDHIFVLHREGKGGLCAEYMAGFQWGLERDYQVLCEMDADGSHAPEQLHLLLAEITNGADLVIGSRYVPGGRVVNWPKNRWLLSKGGNVYISVALGAGLTDMTAGYRAFRREVLEALPLDELSNAGYIFQVEIAYRAVEAGFDVREVPITFTEREIGESKLDGSFVKDSLLEVTKWGLKHRGGQAKELSKEMVGLLNYEWKHFKKRNTWL

SEQ ID NO: 677 - DNA, 18 bp, Artificial Sequence
  Description of Artificial Sequence: primer
ggaaacagtatgaccatg

SEQ ID NO: 678 - DNA, 17 bp, Artificial Sequence
  Description of Artificial Sequence: primer
gtaaaacgacggccagt

What is claimed:

1. An isolated nucleic acid molecule consisting of the nucleotide sequence set forth in SEQ ID NO:1, or a complement thereof.

2. An isolated nucleic acid molecule which encodes a polypeptide consisting of the amino acid sequence set forth in SEQ ID NO:2, or a complement thereof.

* * * * *